US012788804B2

(12) United States Patent
Chen et al.

(10) Patent No.: US 12,788,804 B2
(45) Date of Patent: Nov. 10, 2026

(54) NUCLEOBASE EDITORS

(71) Applicant: AGENCY FOR SCIENCE, TECHNOLOGY AND RESEARCH, Singapore (SG)

(72) Inventors: Liwei Chen, Singapore (SG); Wei Leong Chew, Singapore (SG)

(73) Assignee: AGENCY FOR SCIENCE, TECHNOLOGY AND RESEARCH, Singapore (SG)

(*) Notice: Subject to any disclaimer, the term of this patent is extended or adjusted under 35 U.S.C. 154(b) by 1072 days.

(21) Appl. No.: 17/788,270

(22) PCT Filed: Dec. 28, 2020

(86) PCT No.: PCT/SG2020/050787
§ 371 (c)(1),
(2) Date: Jun. 22, 2022

(87) PCT Pub. No.: WO2021/133261
PCT Pub. Date: Jul. 1, 2021

(65) Prior Publication Data

US 2023/0051661 A1 Feb. 16, 2023

(30) Foreign Application Priority Data

Dec. 26, 2019 (SG) .......................... 10201913340Q

(51) Int. Cl.

| | |
|---|---|
| ***A61K 38/53*** | (2006.01) |
| ***A61K 38/00*** | (2006.01) |
| ***A61K 38/45*** | (2006.01) |
| ***A61K 38/50*** | (2006.01) |
| ***C07K 14/47*** | (2006.01) |
| ***C12N 9/00*** | (2006.01) |
| ***C12N 9/78*** | (2006.01) |
| ***C12N 15/62*** | (2006.01) |

(52) U.S. Cl.
CPC .............. *A61K 38/53* (2013.01); *A61K 38/45* (2013.01); *A61K 38/50* (2013.01); *C07K 14/47* (2013.01); *C12N 9/78* (2013.01); *C12N 9/93* (2013.01); *C12N 15/62* (2013.01); *C12Y 305/04001* (2013.01); *C12Y 605/01001* (2013.01); *A61K 38/00* (2013.01); *C07K 2319/00* (2013.01)

(58) Field of Classification Search
None
See application file for complete search history.

(56) References Cited

FOREIGN PATENT DOCUMENTS

| | | | | |
|---|---|---|---|---|
| CN | 107384920 A | | 11/2017 | |
| WO | WO-2017070632 A2 | * | 4/2017 | ............. A61P 31/12 |
| WO | WO-2018/165629 A1 | | 9/2018 | |
| WO | WO-2018/176009 A1 | | 9/2018 | |
| WO | WO-2019/005886 A1 | | 1/2019 | |

OTHER PUBLICATIONS

NCBI WP_306789577.1 (2005) (Year: 2005).*
NCBI NP_037039.1 (2018) (Year: 2018).*
NCBI NP_033558.2 (2008) (Year: 2008).*
Office Action issued in Japanese Application No. 2022-539125, dated Feb. 10, 2025.
First Office Action in CN Application No. 202080086531.0 dated Dec. 29, 2023, 11 pages.
Iyer et al., "Precise therapeutic gene correction by a simple nuclease-induced double-stranded break", *Nature* 568, 561-565 (2019).
Gaudelli et al., "Programmable base editing of A•T to G•C in genomic DNA without DNA cleavage", Nature 551, 464-471 (2017).
Ran et al., "Double Nicking by RNA-Guided CRISPR Cas9 for Enhanced Genome Editing Specificity", *Cell* 154, 1380-1389 (2013).
Komor et al., "Programmable editing of a target base in genomic DNA without double-stranded DNA cleavage", *Nature* 533, 420-424 (2016).
Nishida et al., "Targeted nucleotide editing using hybrid prokaryotic and vertebrate adaptive immune systems", *Science* 353, Issue 6305, aaf8729 (2016), 10 pages.
Komor et al., "Improved base excision repair inhibition and bacteriophage Mu Gam protein yields C:G-to-T:A base editors with higher efficiency and product purity", *Sci. Adv.* 3, eaao4774 (2017), 9 pages.
Kim et al., "Adenine base editors catalyze cytosine conversions in human cells", *Nat. Biotechnol.* 37, 1145-1148 (2019).
S. S. Wallace, "Base excision repair: A critical player in many games", *DNA Repair* 19, 14-26 (2014).
Mol et al., "Crystal Structure of Human Uracil-DNA Glycosylase in Complex with a Protein Inhibitor: Protein Mimicry of DNA", *Cell* 82, 701-708 (1995).
Husain et al., "Specific inhibition of DNA polymerase ß by its 14 kDa domain: role of single- and double-stranded DNA binding and 5'-phosphate recognition", *Nucleic Acid Res.* 23, 1597-1603 (1995).
Litonjua et al., "Very important pharmacogene summary ADRB2. *Pharmacogenet", Genomics* 20, 64-69 (2010).
Bruzzone et al., "Loss-of-function and residual channel activity of connexin26 mutations associated with non-syndromic deafness", *FEBS Lett.* 533, 79-88 (2003).
Snoeckx et al., "GJB2 mutations and degree of hearing loss: a multicenter study", *Am. J. Hum. Genet.* 77, 945-957 (2005).
K. S. Gajula, "Designing an Elusive C•G→G•C CRISPR Base Editor", *Trends Biochem Sci.* 44, 91-94 (2018).
(Continued)

*Primary Examiner* — Tara L Martinez
(74) *Attorney, Agent, or Firm* — MARSHALL, GERSTEIN & BORUN LLP

(57) ABSTRACT

The present invention refers to a fusion protein or a protein complex comprising a DNA binding protein (DnaBP), a nucleobase modifying protein (NMP), and a Base Excision Repair associated protein (BERAP. Also, described herein are a method of replacing a cytosine with a guanine on a DNA strand in a cell and a method of treating a subject having or suspected of having a disease or disorder.

6 Claims, 31 Drawing Sheets

Specification includes a Sequence Listing.

(56) References Cited

OTHER PUBLICATIONS

R. E. London, "The structural basis of XRCC1-mediated DNA repair", *DNA Repair* 30, 90-103 (2015).
Sternberg et al., "DNA interrogation by the CRISPR RNA-guided endonuclease Cas9", *Nature* 507, 62-67 (2014).
Anzalone et al., "Search-and-replace genome editing without double-strand breaks or donor DNA", *Nature,* vol. 576, No. 7785, Dec. 2019, pp. 149-157.
Richardson et al., "Enhancing homology-directed genome editing by catalytically active and inactive CRISPR-Cas9 using asymmetric donor DNA", *Nat. Biotechnol.* 34, 339-344 (2016).
Idriss et al., "DNA polymerase beta", *Int J Biochem Cell Biol.,* 34, (2002), pp. 321-324.
Kim et al., "Increasing the genome-targeting scope and precision of base editing with engineered Cas9-cytidine deaminase fusions", *Nat. Biotechnol.* 35, 371-376 (2017).
Gehrke et al., "An APOBEC3A-Cas9 base editor with minimized bystander and off-target activities", *Nat. Biotechnol.* 36, 977-982 (2018).
Wang et al., "Efficient base editing in methylated regions with a human APOBEC3A-Cas9 fusion", *Nat. Biotechnol.* 36, 946-949 (2018).
Hu et al., "Evolved Cas9 variants with broad PAM compatibility and high DNA specificity", *Nature* 556, 57-63 (2018).
Nishimasu et al., "Engineered CRISPR-Cas9 nuclease with expanded targeting space", *Science* 361, 1259-1262 (2018).
Huang et al., "Circularly permuted and PAM-modified Cas9 variants broaden the targeting scope of base editors", *Nat. Biotechnol.* 37, 626-631 (2019).
Rees et al., "Improving the DNA specificity and applicability of base editing through protein engineering and protein delivery", *Nat. Commun.* 8, 15790 (2017), 10 pages.
Li et al., "Base editing with a Cpf1-cytidine deaminase fusion", *Nat. Biotechnol.* 36, 324-327 (2018).
De Boer et al., "An in vitro assay for frameshift mutations: hotspots for deletions of 1 bp by Klenow-fragment polymerase share a consensus DNA sequence", *Genetics* 118, 181-191 (1988).
Camps et al., "Targeted gene evolution in Escherichia coli using a highly error-prone DNA polymerase I", *Proc. Natl. Acad. Sci. U.S.A.* 100, 9727-9732 (2003).
Troll et al., "Mutagenesis and functional selection protocols for directed evolution of proteins in *E. coli", J. Vis. Exp.* 49, 2505 (2011).
KEGG BER pathway: <https://www.genome.jp/kegg-bin/show_pathway?hsa03410> (accessed Dec. 12, 2019).
Tanenbaum et al., "A Protein-Tagging System for Signal Amplification in Gene Expression and Fluorescence Imaging", *Cell* 159, 635-646 (2014).
National Center for Biotechnology Information. ClinVar; [VCV000209223.1], https://www.ncbi.nlm.nih.gov/clinvar/variation/VCV000209223.1 (accessed Dec. 12, 2019).
National Center for Biotechnology Information. ClinVar; [VCV000003893.1], https://www.ncbi.nlm.nih.gov/clinvar/variation/VCV000003893.1 (accessed Dec. 12, 2019).
National Center for Biotechnology Information. ClinVar; [VCV000003890.3], https://www.ncbi.nlm.nih.gov/clinvar/variation/VCV000003890.3 (accessed Dec. 12, 2019).
National Center for Biotechnology Information. ClinVar; [VCV000007785.5], https://www.ncbi.nlm.nih.gov/clinvar/variation/VCV000007785.5 (accessed Dec. 12, 2019).
Villiger et al., "Treatment of a metabolic liver disease by in vivo genome base editing in adult mice", *Nat. Med.* 24, 1519-1525 (2018).
Rudimentary ClinVar search for disease associated G>C SNPs: <https://www.ncbi.nlm.nih.gov/clinvar/?term=G%3EC+%5Bvariation%5D>, 11 pages.
Rudimentary ClinVar search for disease associated C>G SNPs: <https://www.ncbi.nlm.nih.gov/clinvar/?term=C%3EG+%5Bvariation%5D>, 12 pages.
General Information on Huntington Disease: <https://rarediseases.info.nih.gov/diseases/6677/huntington-disease> (accessed Dec. 13, 2019), 10 pages.
Zong et al., "Precise base editing in rice, wheat and maize with a Cas9-cytidine deaminase fusion", *Nat. Biotechnol.* 35, 438-440 (2017).
Mishra et al., "Genome Editing in Rice: Recent Advances, Challenges, and Future Implications", *Front. Plant Sci.* 9, 1361 (2019).
Kurt, I. C et al., "CRISPR C-to-G base editors for inducing targeted DNA transversions in human cells", *Nat. Biotechnol.* (2020). https://doi.org/10.1038/s41587-020-0609-x, 24 pages.
Zhao, et al., "Glycosylase Base Editors Enable C-to-A and C-to-G in base changes", *Nat. Biotechnol.,* 39, , 2021, <https://doi.org/10.1038/s41587-020-0592-2>, 11 pages.
Prasad et al., "Pol β associated complex and base excision repair factors in mouse fibroblasts", NAR, 40, (2012), 12 pages.
Parlanti et al., "Human base excision repair complex is physically associated to DNA replication and cell cycle regulatory proteins", NAR, 35, (2007), 9 pages.
Chen et al., "Programmable C:G to G:C Genome Editing With CRISPR-Cas9-directed Base Excision Repair Proteins", Nature Communications, 12:1384, 2021, 7 pages.
Paquet et al., "Efficient Introduction of Specific Homozygous and Heterozygous Mutations Using CRISPR/Cas9", Nature, 533, 2016, 18 pages.
Ma et al., "Targeted AID-mediated Mutagenesis (TAM) Enables Efficient Genomic Diversification in Mammalian Cells", Nat Methods, 13, 2016, 9 pages.
Halperin et al., "CRISPR-guided DNA Polymerases Enable Diversification of All Nucleotides in a Tunable Window", Nature, 560, 2018, 19 pages.
Grunewald et al., "Transcriptome-wide off-target RNA Editing Induced by CRISPR-guided DNA Base Editors", Nature, 569, 2019, 21 pages.
Zhou et al., "Off-target RNA Mutation Induced by DNA Base Editing and Its Elimination by Mutagenesis", Nature, vol. 571, 2019, 18 pages.
Kim et al., "Increasing the Genome-targeting Scope and Precision of Base Editing With Engineered Cas9-cytidine Deaminase Fusions", Nat Biotech, vol. 35, No. 4, 2017, pp. 371-377.
Excel sheets titled "ClinVar GtoC". These are for "https://www.ncbi.nlm.nih.gov/clinvar/?term=G%3EC," as recited in the PCT publication as originally filed at paragraphs [0084], [0085] and [0086].
Excel sheets titled "ClinVarCtoG". These are for "https://www.ncbi.nlm.nih.gov/clinvar/?term=C%3EG" as recited in the PCT publication as originally filed at paragraphs [0084], [0085] and [0086].
Second Office Action in CN Application No. 202080086531.0 dated Jul. 31, 2024, 16 pages.
Communication Pursuant to Rules 70(2) and 70a(2) EPC in EP Application No. 20907238.8 dated Mar. 15, 2024, 1 page.
European Search Report in EP Application No. 20907238.8 dated Feb. 26, 2024, 10 pages.
Lei et al., "APOBEC3 Induces Mutations During Repair of CRISPR-Cas9-generated DNA Breaks", Nature Structural & Molecular Biology, vol. 25, Jan. 2018, pp. 45-52.
Hegde et al., "Early Steps in the DNA Base Excision/Single-Strand Interruption Repair Pathway in Mammalian Cells", Cell Res., vol. 18, No. 1, Jan. 2008, 32 pages.
Komor et al., "Programmable Editing of a Target Base in Genomic DNA Without Double-stranded DNA Cleavage", Nature, vol. 533, May 19, 2016, pp. 17 pages.
Chen et al., "Precise and Programmable C:G to G:C Base Editing in Genomic DNA", bioRxiv, 21, Jul. 2020, 19 pages; https://doi.org/10.1101/2020.07.21.213827.
Search Report and Written Opinion in International Application No. PCT/SG2020/050787 dated Mar. 8, 2021, 14 pages.
Second Office Action in CN Application No. 202080086531.0 dated Jul. 31, 2024, 11 pages.
Second Office Action in JP Application No. JP 2022-539125 dated Aug. 18, 2025, 8 pages.

* cited by examiner

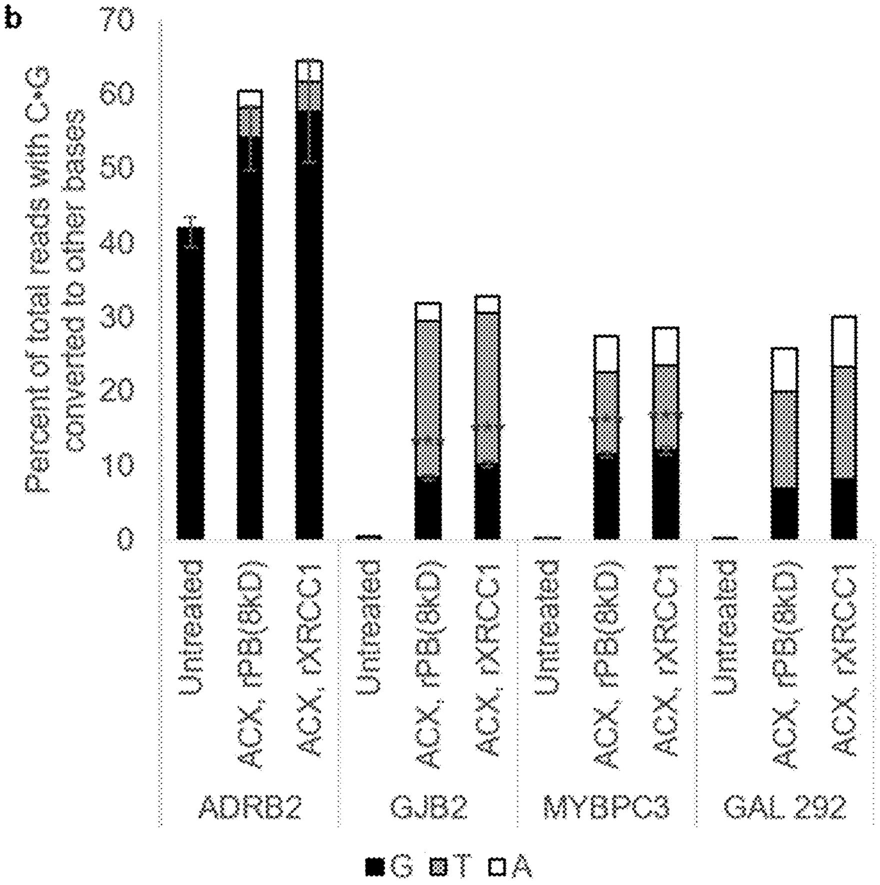
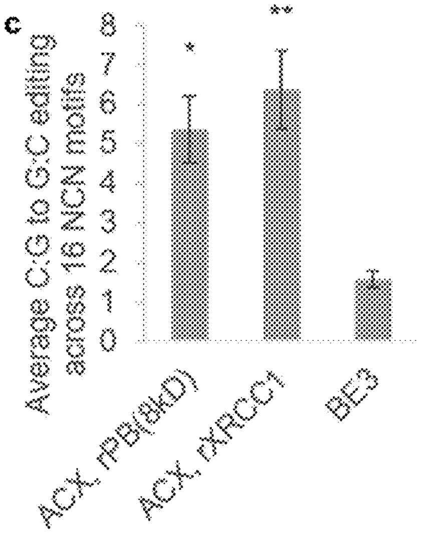
Figure 6 (continued)

a ADRB2

| WT | $C_1$ | $C_2$ | $C_3$ | $T_4$ | $T_5$ | $T_6$ | $C_7$ | $C_8$ | $T_9$ | $G_{10}$ | $C_{11}$ | $G_{12}$ | $T_{13}$ | $G_{14}$ | $A_{15}$ | $C_{16}$ | $G_{17}$ | $T_{18}$ | $C_{19}$ | $G_{20}$ |
|---|---|---|---|---|---|---|---|---|---|---|---|---|---|---|---|---|---|---|---|---|
| A | 0.0 | 0.0 | 0.0 | 0.1 | 0.0 | 0.0 | 0.1 | 0.0 | 0.0 | 0.1 | 0.0 | 0.2 | 0.1 | 0.1 | 99.8 | 0.0 | 0.3 | 0.0 | 0.0 | 0.2 |
| C | 99.9 | 99.9 | 99.8 | 0.2 | 0.2 | 0.1 | 54.5 | 99.4 | 0.1 | 0.1 | 99.8 | 0.4 | 0.1 | 0.1 | 0.0 | 99.9 | 0.1 | 0.4 | 99.9 | 0.1 |
| G | 0.0 | 0.0 | 0.0 | 0.1 | 0.1 | 0.0 | 44.9 | 0.0 | 0.1 | 99.7 | 0.0 | 99.5 | 0.2 | 99.7 | 0.2 | 0.0 | 99.6 | 0.3 | 0.0 | 99.5 |
| T | 0.1 | 0.1 | 0.1 | 99.6 | 99.7 | 99.9 | 0.6 | 0.5 | 99.7 | 0.1 | 0.2 | 0.0 | 99.5 | 0.0 | 0.1 | 0.1 | 0.1 | 99.3 | 0.1 | 0.2 |

| XRCC | $C_1$ | $C_2$ | $C_3$ | $T_4$ | $T_5$ | $T_6$ | $C_7$ | $C_8$ | $T_9$ | $G_{10}$ | $C_{11}$ | $G_{12}$ | $T_{13}$ | $G_{14}$ | $A_{15}$ | $C_{16}$ | $G_{17}$ | $T_{18}$ | $C_{19}$ | $G_{20}$ |
|---|---|---|---|---|---|---|---|---|---|---|---|---|---|---|---|---|---|---|---|---|
| A | 0.1 | 0.0 | 0.1 | 0.0 | 0.1 | 0.0 | 0.7 | 0.1 | 0.0 | 0.1 | 0.0 | 0.3 | 0.0 | 0.1 | 99.8 | 0.0 | 0.2 | 0.0 | 0.0 | 0.3 |
| C | 99.6 | 99.9 | 99.6 | 0.2 | 0.1 | 0.1 | 10.6 | 99.2 | 0.1 | 0.1 | 99.8 | 0.2 | 0.1 | 0.1 | 0.0 | 99.9 | 0.0 | 0.3 | 99.9 | 0.1 |
| G | 0.0 | 0.0 | 0.0 | 0.2 | 0.1 | 0.1 | 87.6 | 0.1 | 0.1 | 99.8 | 0.0 | 99.4 | 0.3 | 99.8 | 0.1 | 0.0 | 99.6 | 0.2 | 0.0 | 99.5 |
| T | 0.3 | 0.1 | 0.3 | 99.6 | 99.7 | 99.8 | 1.1 | 0.6 | 99.8 | 0.1 | 0.2 | 0.0 | 99.6 | 0.0 | 0.1 | 0.1 | 0.1 | 99.4 | 0.1 | 0.2 |

| rPB | $C_1$ | $C_2$ | $C_3$ | $T_4$ | $T_5$ | $T_6$ | $C_7$ | $C_8$ | $T_9$ | $G_{10}$ | $C_{11}$ | $G_{12}$ | $T_{13}$ | $G_{14}$ | $A_{15}$ | $C_{16}$ | $G_{17}$ | $T_{18}$ | $C_{19}$ | $G_{20}$ |
|---|---|---|---|---|---|---|---|---|---|---|---|---|---|---|---|---|---|---|---|---|
| A | 0.1 | 0.0 | 0.1 | 0.0 | 0.1 | 0.0 | 1.0 | 0.3 | 0.1 | 0.1 | 0.0 | 0.2 | 0.1 | 0.1 | 99.7 | 0.0 | 0.3 | 0.0 | 0.0 | 0.2 |
| C | 99.5 | 99.7 | 99.1 | 0.2 | 0.1 | 0.1 | 25.4 | 98.5 | 0.1 | 0.1 | 99.8 | 0.3 | 0.1 | 0.1 | 0.0 | 99.9 | 0.1 | 0.4 | 99.9 | 0.1 |
| G | 0.0 | 0.0 | 0.0 | 0.1 | 0.1 | 0.1 | 71.4 | 0.1 | 0.1 | 99.8 | 0.0 | 99.5 | 0.2 | 99.8 | 0.2 | 0.0 | 99.5 | 0.3 | 0.0 | 99.6 |
| T | 0.4 | 0.3 | 0.7 | 99.6 | 99.7 | 99.8 | 2.2 | 1.1 | 99.7 | 0.1 | 0.2 | 0.0 | 99.6 | 0.1 | 0.1 | 0.1 | 0.1 | 99.3 | 0.1 | 0.1 |

b MYBPC3

| WT | $G_1$ | $A_2$ | $T_3$ | $A_4$ | $G_5$ | $A_6$ | $C_7$ | $C_8$ | $T_9$ | $G_{10}$ | $T_{11}$ | $G_{12}$ | $T_{13}$ | $G_{14}$ | $C_{15}$ | $A_{16}$ | $T_{17}$ | $G_{18}$ | $G_{19}$ | $A_{20}$ |
|---|---|---|---|---|---|---|---|---|---|---|---|---|---|---|---|---|---|---|---|---|
| A | 0.1 | 99.8 | 0.7 | 99.8 | 0.1 | 99.9 | 0.1 | 0.0 | 2.3 | 1.0 | 0.7 | 7.2 | 0.1 | 0.1 | 0.0 | 99.9 | 1.4 | 3.0 | 0.2 | 99.9 |
| C | 0.0 | 0.0 | 0.0 | 0.0 | 0.1 | 0.0 | 99.7 | 99.6 | 0.1 | 0.0 | 0.0 | 0.0 | 0.0 | 0.0 | 99.2 | 0.0 | 0.0 | 0.0 | 0.0 | 0.0 |
| G | 99.8 | 0.1 | 0.0 | 0.1 | 99.8 | 0.1 | 0.1 | 0.3 | 0.0 | 99.0 | 0.0 | 92.8 | 0.0 | 99.9 | 0.4 | 0.0 | 0.0 | 97.0 | 99.8 | 0.1 |
| T | 0.0 | 0.0 | 99.3 | 0.1 | 0.0 | 0.0 | 0.1 | 0.1 | 97.6 | 0.0 | 99.3 | 0.0 | 99.8 | 0.0 | 0.3 | 0.1 | 98.5 | 0.0 | 0.0 | 0.0 |

| XRCC | $G_1$ | $A_2$ | $T_3$ | $A_4$ | $G_5$ | $A_6$ | $C_7$ | $C_8$ | $T_9$ | $G_{10}$ | $T_{11}$ | $G_{12}$ | $T_{13}$ | $G_{14}$ | $C_{15}$ | $A_{16}$ | $T_{17}$ | $G_{18}$ | $G_{19}$ | $A_{20}$ |
|---|---|---|---|---|---|---|---|---|---|---|---|---|---|---|---|---|---|---|---|---|
| A | 0.2 | 99.7 | 0.9 | 99.8 | 0.2 | 99.8 | 5.3 | 2.0 | 2.1 | 1.1 | 0.6 | 7.2 | 0.1 | 0.1 | 0.0 | 99.9 | 1.1 | 3.0 | 0.2 | 99.9 |
| C | 0.2 | 0.1 | 0.1 | 0.0 | 0.1 | 0.0 | 69.4 | 94.0 | 0.1 | 0.1 | 0.0 | 0.0 | 0.1 | 0.0 | 99.3 | 0.0 | 0.0 | 0.0 | 0.0 | 0.0 |
| G | 99.6 | 0.1 | 0.0 | 0.1 | 99.7 | 0.1 | 13.9 | 1.3 | 0.0 | 98.8 | 0.0 | 92.7 | 0.0 | 99.9 | 0.4 | 0.0 | 0.0 | 97.0 | 99.8 | 0.1 |
| T | 0.0 | 0.0 | 99.0 | 0.1 | 0.0 | 0.1 | 11.3 | 2.7 | 97.8 | 0.0 | 99.3 | 0.1 | 99.8 | 0.0 | 0.3 | 0.1 | 98.8 | 0.0 | 0.0 | 0.0 |

| rPB | $G_1$ | $A_2$ | $T_3$ | $A_4$ | $G_5$ | $A_6$ | $C_7$ | $C_8$ | $T_9$ | $G_{10}$ | $T_{11}$ | $G_{12}$ | $T_{13}$ | $G_{14}$ | $C_{15}$ | $A_{16}$ | $T_{17}$ | $G_{18}$ | $G_{19}$ | $A_{20}$ |
|---|---|---|---|---|---|---|---|---|---|---|---|---|---|---|---|---|---|---|---|---|
| A | 0.3 | 99.7 | 0.9 | 99.7 | 0.2 | 99.8 | 5.2 | 2.4 | 2.2 | 1.2 | 0.6 | 7.6 | 0.1 | 0.1 | 0.1 | 99.9 | 1.2 | 2.9 | 0.2 | 99.9 |
| C | 0.1 | 0.1 | 0.1 | 0.0 | 0.1 | 0.0 | 71.1 | 92.9 | 0.1 | 0.1 | 0.1 | 0.0 | 0.0 | 0.0 | 99.2 | 0.0 | 0.0 | 0.0 | 0.0 | 0.0 |
| G | 99.6 | 0.1 | 0.0 | 0.1 | 99.7 | 0.1 | 12.3 | 1.4 | 0.0 | 98.7 | 0.0 | 92.3 | 0.1 | 99.9 | 0.4 | 0.0 | 0.0 | 97.1 | 99.8 | 0.1 |
| T | 0.0 | 0.1 | 99.0 | 0.2 | 0.0 | 0.1 | 11.3 | 3.3 | 97.7 | 0.0 | 99.3 | 0.1 | 99.8 | 0.0 | 0.3 | 0.1 | 98.8 | 0.0 | 0.0 | 0.0 |

Figure 8 a c

NUCLEOBASE EDITORS

INCORPORATION BY REFERENCE OF MATERIAL SUBMITTED ELECTRONICALLY

The Sequence Listing, which is a part of the present disclosure, is submitted concurrently with the specification as a text file. The name of the text file containing the Sequence Listing is "57646_Seqlisting.txt", which was created on Jun. 21, 2022, and is 645,600 bytes in size. The subject matter of the Sequence Listing is incorporated herein in its entirety by reference.

CROSS-REFERENCE TO RELATED APPLICATIONS

This application claims the benefit of priority of Singapore provisional application No. 10201913340Q, filed on 26 Dec. 2019, the contents of it being hereby incorporated by reference in its entirety for all purposes.

FIELD OF THE INVENTION

The present invention relates to the field of molecular biology biotechnology, specifically the field of gene editing and more specifically nucleobase editing.

BACKGROUND OF THE INVENTION

Many human genetic diseases are caused by single-nucleotide polymorphisms (SNPs), in which the disease and healthy alleles differ by a single DNA base. CRISPR-Cas9 nuclease is commonly used to edit genomic DNA in a targetable fashion. Following DNA cleavage, three major repair mechanisms can be involved in fixing that break—homology directed repair (HDR), micro-homology mediated end joining (MMEJ), and non-homologous end joining (NHEJ). In the presence of a donor DNA/RNA, HDR may occur. However, previous studies were only able to achieve low levels of precise gene editing (0.1 to 5%). MMEJ requires that the double stranded break be formed at a region with micro-homology and hence restricts the targeting range of CRISPR-Cas9. NHEJ is the predominant pathway in repairing Cas9-induced double stranded breaks. Unfortunately, it introduces a variety of random indels. For therapeutic applications where precise point mutations are necessary, NHEJ is unable to restore a defective gene and is hence inadequate.

Base editors can correct these SNPs by converting the targeted DNA bases into another base in a controllable and efficient fashion. Current technology enables the conversion of CG base pairs to T·A base pairs using cytosine base editors (CBEs) (A. C. Komor, et al., *Nature* 533, 420-424 (2016); K. Nishida et al., *Science* 353, aaf8729 (2016); A. C. Komor, et al., *Sci. Adv.* 3, eaao4774 (2017)) and AT base pairs to GC base pairs using adenine base editors (ABEs) (N. M. Gaudelli, et al., *Nature* 551, 464-471 (2017)), which together represent half of all known disease-associated SNPs. CBEs and ABEs are also known to effect some CG to GC edits as byproducts, but they cannot effect such transversions at efficiencies or purities necessary for therapeutic use, and hence the remaining half of these SNPs are not addressable by current base-editors.

Therefore, there is a need to provide novel nucleobase editors which facilitate C:G to G:C editing (CGBEs) with high efficiency, specificity, and purity.

SUMMARY OF THE INVENTION

In one aspect, the present disclosure refers to a fusion protein or a protein complex comprising a DNA binding protein (DnaBP), a nucleobase modifying protein (NMP), and a Base Excision Repair associated protein (BERAP); wherein the fusion protein or protein complex does not comprise a Uracil binding protein or a catalytically active DNA polymerase.

In another aspect, the present disclosure refers to a fusion protein comprising:

- a first amino acid sequence that is at least 80% identical to the amino acid sequence of any one of SEQ ID NOs: 1-2,
- a second amino acid sequence that is at least 80% identical to the amino acid sequence of SEQ ID NO: 3,
- a third amino acid sequence that is at least 80% identical to the amino acid sequence of SEQ ID NO: 4-10.

In another aspect, the present disclosure refers to a fusion protein comprising a sequence of any one of SEQ ID NOs: 42 to 72.

In yet another aspect, the present disclosure refers to protein complex comprising:

- a first protein comprising an amino acid sequence that is at least 80% identical to the amino acid sequence of any one of SEQ ID NOs: 1-2,
- a second protein comprising an amino acid sequence that is at least 80% identical to the amino acid sequence of SEQ ID NO: 3,
- a third protein comprising an amino acid sequence that is at least 80% identical to the amino acid sequence of SEQ ID NO: 4-11.

In yet another aspect, the present disclosure refers to a protein-nucleic acid complex comprising a nucleic acid molecule and any one of:

- the fusion protein or protein complex as disclosed herein,
- the fusion protein as disclosed herein; and
- the protein complex as disclosed herein.

In yet another aspect, the present disclosure refers to a pharmaceutical composition comprising the fusion protein or protein complex as disclosed herein, the fusion protein as disclosed herein, the protein complex as disclosed herein, or the protein-nucleic acid complex as disclosed herein.

In yet another aspect, the present disclosure refers to a method of replacing a cytosine with a guanine on a DNA strand in a cell, said method comprises introducing to the cell the fusion protein or protein complex as disclosed herein, the fusion protein as disclosed herein, the protein complex as disclosed herein, or the protein-nucleic acid complex as disclosed herein.

In yet another aspect, the present disclosure refers to a polynucleotide encoding the fusion protein or protein complex as disclosed herein, the fusion protein as disclosed herein, the protein complex as disclosed herein, or the protein-nucleic acid complex as disclosed herein.

In yet another aspect, the present disclosure refers to a vector comprising the polynucleotide as disclosed herein.

In yet another aspect, the present disclosure refers to a cell comprising the fusion protein or protein complex as disclosed herein, the fusion protein as disclosed herein, the protein complex as disclosed herein, or the protein-nucleic acid complex as disclosed herein.

In yet another aspect, the present disclosure refers to a method of treating a subject having or suspected of having a disease or disorder comprising administering the fusion protein or protein complex as disclosed herein, the fusion protein as disclosed herein, the protein complex as disclosed herein, the protein complex as disclosed herein, the protein-nucleic acid complex as disclosed herein, the pharmaceutical composition as disclosed herein, the polynucleotide as disclosed herein, or the vector as disclosed herein to the subject.

In yet another aspect, the present disclosure refers to a method for editing a target nucleobase pair of a double-stranded DNA sequence, the method comprising:

a. contacting a target region of the double-stranded DNA sequence with a complex comprising a nucleobase editor and a guide nucleic acid, wherein the target region comprises the target nucleobase pair;
b. inducing strand separation of said target region;
c. converting a first nucleobase of said target nucleobase pair in a single strand of the target region to a second nucleobase;
d. excising said second nucleobase from the double-stranded DNA sequence to produce an abasic site; and
e. promoting the Base Excision Repair (BER) pathway to repair the abasic site, generating a third nucleobase at the abasic site, wherein the third nucleobase is different from the first nucleobase.

BRIEF DESCRIPTION OF THE DRAWINGS

The invention will be better understood with reference to the detailed description when considered in conjunction with the non-limiting examples and the accompanying drawings, in which:

FIG. 1 describes an initial screen of CGBE candidates for C:G to G:C editing.

FIG. 2** describes the sequence context and editing window for two selected CGBEs.

FIG. 3 illustrates how CGBE induces efficient C:G to G:C editing as the predominant product.

FIG. 4 shows the CGBE Initial screen of CGBE candidates on HEK2-1.

FIG. 5 illustrates the results of the initial screen of CGBE candidates on HEK3.

FIG. 6 illustrates the further characterization of shortlisted CGBE candidates.

FIG. 7 illustrates the indel rates of shortlisted CGBE candidates at genomic sites.

FIG. 8 shows 2 images showing the representative data of CGBE editing at (a) ADRB2 and (b) MYBPC3. WT denotes wild-type untreated cells; XRCC denotes ACX, XRCC1; rPB denotes ACX, rPB(8 kD). Note that ADRB2 contains naturally occurring polymorphism in HEK293AAV cells.

FIG. 9 illustrates that ACX, rXRCC1 is one of the best performers out of shortlisted CGBE candidates.

FIG. 14** illustrates ACX, rXRCC1; ACX, rPB(8 kD); and BE3 editing in HTB9 cells.

FIG. 17 illustrates ACX, rXRCC1; ACX, rPB(8 kD); and BE3 editing in eHAP cells.

FIG. 20 illustrates ACX, rXRCC1; ACX, rPB(8 kD); and BE3 exhibit low editing efficiencies in H9 stem cells.

GENERAL DEFINITIONS

Figure 1:
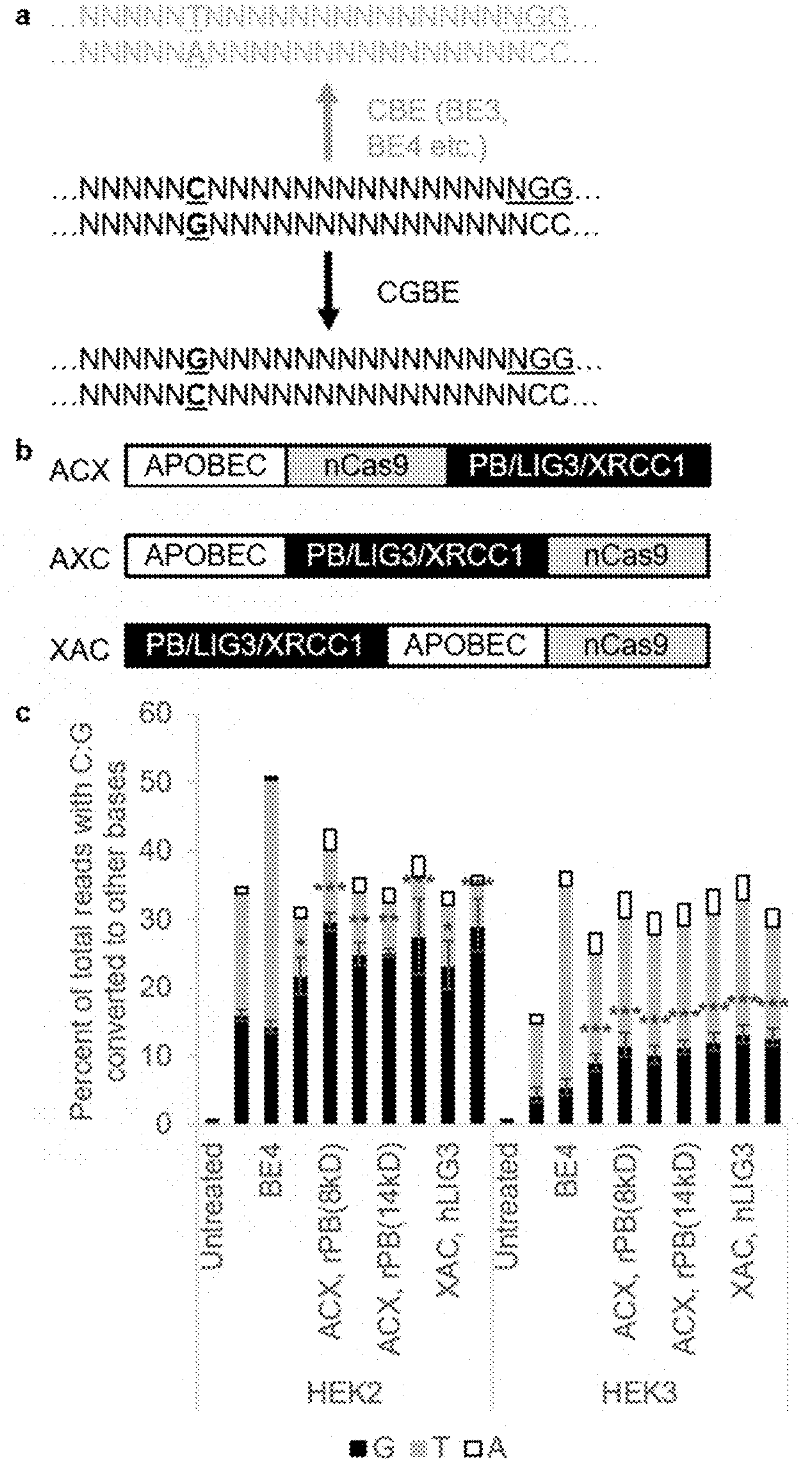
FIG. 1 shows 2 illustrations: one showing the difference between C:G to G:C Base Editors (CGBE) and (Cytosine base editors) CBE; the other showing the CGBE candidates; and 1 column graph. (a) CBEs like BE3 and BE4 predominantly convert C:G to T:A while CGBE aims to predominantly convert C:G to G:C. (b) CGBE candidates were designed in three orientations—ACX, AXC, and XAC, where X denotes the fused BER protein (or Base Excision Repair associated protein, BERAP). (c) Seven candidates were selected for their high C:G to G:C editing at both HEK2 and HEK3. Targeted C's are denoted in a box. PAMs are underlined. The lower editing at HEK3 is likely due to a disfavored motif (refer to data in FIG. 2*a*). *p<0.05; p<0.01; *p<0.001 (one-way ANOVA against 'Untreated,' Dunn-Šidák; n=3, mean±standard error).

Several terms that are employed throughout the specification are generally defined in the following paragraphs. Other definitions may also found within the body of the specification.

As used herein, the terms "about" and "approximately," in reference to a number, is used herein to include numbers that fall within a range of 20%, 10%, 5%, 2.5%, 2%, 1.5% or 1% in either direction (greater than or less than) of the number unless otherwise stated or otherwise evident from the context (except where such number would exceed 100% of a possible value).

The terms “polynucleotide”, “nucleic acid” and “oligonucleotide” are used interchangeably and refer to a polymeric form of nucleotides of any length, either deoxyribonucleotides or ribonucleotides or analogues thereof. Polynucleotides can have any three-dimensional structure and may perform any function, known or unknown. The following are non-limiting examples of polynucleotides: a gene or gene fragment (for example, a probe, primer, EST or SAGE tag), exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes and primers. A polynucleotide can comprise modified nucleotides, such as methylated nucleotides and nucleotide analogues. If present, modifications to the nucleotide structure can be imparted before or after assembly of the polynucleotide. The sequence of nucleotides can be interrupted by non-nucleotide components. A polynucleotide can be further modified after polymerization, such as by conjugation with a labelling component. The term also refers to both double- and single-stranded molecules. Unless otherwise specified or required, a polynucleotide encompasses both the double-stranded form and each of two complementary single-stranded forms known or predicted to make up the double-stranded form. As used herein, the term “polypeptide” generally has its art-recognized meaning of a polymer of amino acids. The term is also used to refer to specific functional classes of polypeptides, such as, for example, nucleases, antibodies, etc.

As used herein, the term “variant” refers to an entity that shows significant structural identity with a reference entity but differs structurally from the reference entity in the presence or level of one or more chemical moieties as compared with the reference entity. In many embodiments, a variant also differs functionally from its reference entity. In general, whether a particular entity is properly considered to be a “variant” of a reference entity is based on its degree of structural identity with the reference entity. As will be appreciated by those skilled in the art, any biological or chemical reference entity has certain characteristic structural elements. A variant, by definition, is a distinct chemical entity that shares one or more such characteristic structural elements. To give but a few examples, a polypeptide may have a characteristic sequence element comprising a plurality of amino acids having designated positions relative to one another in linear or three-dimensional space and/or contributing to a particular biological function; a nucleic acid may have a characteristic sequence element comprised of a plurality of nucleotide residues having designated positions relative to on another in linear or three-dimensional space. For example, a variant polypeptide may differ from a reference polypeptide as a result of one or more differences in amino acid sequence and/or one or more differences in chemical moieties (e.g., carbohydrates, lipids, etc.) covalently attached to the polypeptide backbone. In some embodiments, a variant polypeptide shows an overall sequence identity with a reference polypeptide (e.g., a nucleic acid modifying enzyme described herein) that is at least 60%, 65%, 70%, 75%, 80%, 85%, 86%, 87%, 88%, 89%, 90%, 91%, 92%, 93%, 94%, 95%, 96%, 97%, or 99%. Alternatively or additionally, in some embodiments, a variant polypeptide does not share at least one characteristic sequence element with a reference polypeptide. In some embodiments, the reference polypeptide has one or more biological activities. In some embodiments, a variant polypeptide shares one or more of the biological activities of the reference polypeptide, e.g., enzymatic activity. In some embodiments, a variant polypeptide lacks one or more of the biological activities of the reference polypeptide. In some embodiments, a variant polypeptide shows a reduced level of one or more biological activities (e.g., enzymatic activity) as compared with the reference polypeptide. In some embodiments, a polypeptide of interest is considered to be a “variant” of a parent or reference polypeptide if the polypeptide of interest has an amino acid sequence that is identical to that of the parent but for a small number of sequence alterations at particular positions. Typically, fewer than 20%, 15%, 10%, 9%, 8%, 7%, 6%, 5%, 4%, 3%, 2% of the residues in the variant are substituted as compared with the parent. In some embodiments, a variant has 10, 9, 8, 7, 6, 5, 4, 3, 2, or 1 substituted residue as compared with a parent. Often, a variant has a very small number (e.g., fewer than 5, 4, 3, 2, or 1) number of substituted functional residues (i.e., residues that participate in a particular biological activity). Furthermore, a variant typically has not more than 5, 4, 3, 2, or 1 additions or deletions, and often has no additions or deletions, as compared with the parent. Moreover, any additions or deletions are typically fewer than about 25, about 20, about 19, about 18, about 17, about 16, about 15, about 14, about 13, about 10, about 9, about 8, about 7, about 6, and commonly are fewer than about 5, about 4, about 3, or about 2 residues. In some embodiments, the parent or reference polypeptide is one found in nature.

As used herein, the term “expression” of a nucleic acid sequence refers to the generation of any gene product from the nucleic acid sequence. In some examples, a gene product can be an RNA transcript. In some embodiments, a gene product can be a polypeptide. In some embodiments, expression of a nucleic acid sequence involves one or more of the following: (1) production of an RNA template from a DNA sequence (e.g., by transcription); (2) processing of an RNA transcript (e.g., by splicing, editing, 5' cap formation, and/or 3' end formation); (3) translation of an RNA into a polypeptide or protein; and/or (4) post-translational modification of a polypeptide or protein.

Unless specified otherwise, all amino acid sequences are shown with the NH2 end on the left and the COOH end on the right, and all DNA/RNA acid sequences are shown with the 5' end on the left and the 3' end on the right.

DETAILED DESCRIPTION

Disclosed herein are compositions and methods of editing a nucleobase, for example, generating a cytosine to guanine mutation (or conversion) in a polynucleotide. The inventors have developed a new class of C:G to G:C Base Editors (CGBEs) which utilize or manipulate the Base Excision Repair (BER) pathway downstream of abasic site creation. When a cytosine to guanine conversion is effected on one strand of a double stranded DNA polynucleotide, the opposing guanine on the opposing strand may also be converted into a cytosine by the intrinsic DNA repair mechanisms. Therefore, this new class of CGBEs edits C:G to G:C (FIG. 1*a*), which opens up treatment avenues to 11% (singular CGBE) to 40% (CGBE with cytosine base editors/adenine base editors (CBE/ABE) disease-associated single-nucleotide polymorphisms (SNPs) (Table 1).

TABLE 1

CGBEs enable potential treatment avenues to previously addressable SNPs associated with human diseases. CBE enables treatment to 48% of all known disease-associated SNPs, while adenine base editors (ABE) enables treatment to 6%. CGBEs effect primarily C:G to G:C and G:C to C:G changes (Row 6 in Table 1) that can correct 11% of disease-associated SNPs. In combination with cytosine base editors (CBEs) or ABEs, CGBEs effect secondarily G to T, C to A, A to C, and T to G edits (Rows 3 and 5 in Table 1). With CBEs, ABEs, and CGBEs, the remaining 7% of SNPs (A to T and T to A) can also be corrected (Row 1 in Table 1).

| Row | From | To | % of SNPs in ClinVar | Equivalent to | | Base-editing route for correction |
|---|---|---|---|---|---|---|
| 1 | A | T | 7 | T | A | A to G (ABE), G to C (CGBE), C to T (CBE) |
| 2 | | G | 48 | | C | ABE |
| 3 | | C | 15 | | G | C to G (CGBE), G to A (CBE) |
| 4 | G | A | 6 | C | T | CBE |
| 5 | | T | 14 | | A | A to G (ABE), G to C (CGBE) |
| 6 | | C | 11 | | G | CGBE |

In one aspect, the present disclosure refers to a fusion protein or a protein complex comprising a DNA binding protein (DnaBP), a nucleobase modifying protein (NMP), and a Base Excision Repair associated protein (BERAP); wherein the fusion protein or protein complex does not comprise a Uracil binding protein or a catalytically active DNA polymerase.

In this aspect, the nucleobase editor comprises at least three components: a DNA binding protein (DnaBP), a nucleobase modifying protein (NMP), and a Base Excision Repair associated protein (BERAP). The nucleobase editor can be a fusion protein (a single polypeptide translated from a fusion gene) or a protein complex. As used herein, the term "protein complex" refers to a composite unit that is a combination of two or more proteins formed by interaction between the proteins. Typically but not necessarily, a "protein complex" is formed by the binding of two or more proteins together through specific non-covalent binding affinities. However, covalent bonds may also be present between the interacting partners. For instance, the two interacting partners can be covalently crosslinked so that the protein complex becomes more stable.

DNA Binding Proteins (DnaBP)

The term "DNA binding protein (DnaBP)" refers to a protein which is capable of binding with a DNA. In some examples, the DNA binding protein is a programmable DNA binding protein, which can be designed or programmed to bind with a specific DNA sequence. In some examples, the programmable DNA binding protein is an RNA-guided DNA binding protein. As used herein, an RNA-guided DNA binding protein interacts or forms a complex with a guide RNA, and can specifically target or bind with a polynucleotide of a specific sequence which usually comprises a sequence complementary to the targeting domain of the gRNA. Upon binding with the target polynucleotide, the DNA binding protein may remain bound with the target polynucleotide, or it may modify the target polynucleotide. In one example, the DNA binding protein is a CRISPR-associated protein (Cas). Many Cas proteins possess endonuclease activity and are also termed Cas nucleases. In a specific example, the DNA binding protein is a Cas protein. In some examples, the Cas protein is selected from the group including but not limited to Cas3, a Cas9, a xCas9, a SpRY Cas9, a HF-Cas9, a Cas9-NG, a circularly permutated Cas9, a codon-optimised Cas9, a domain-fused Cas9, a Cas10 and a Cas12 (also known as Cpf1), a Cas14, a CasX, a Casφ, and variants thereof. In some examples, the DnaBP is a nickase variant of any of the Cas proteins aforementioned. Therefore in some examples, the Cas domain is a Cas nickase (nCas). In some examples, the DnaBP is a Cas9 nickase (or nCas9). The term "Cas9 nickase," as used herein, refers to a Cas9 protein that is capable of cleaving only one strand of a duplexed nucleic acid molecule (e.g., a duplexed DNA molecule). In some examples, the Cas domain is a nuclease inactive Cas (dCas).

The terms "guide RNA" and "gRNA" refer to any nucleic acid that promotes the specific association (or "targeting") of a DNA binding protein to a target sequence either in a cell or in a cell free environment. gRNAs can be unimolecular (comprising a single RNA molecule, and referred to alternatively as chimeric), or modular (comprising more than one, and typically two, separate RNA molecules, such as a crRNA and a tracrRNA, which are usually associated with one another, for instance by duplexing).

Base Excision Repair Associated Proteins (BERAP)

As used herein, the term "Base Excision Repair associated protein (BERAP)" refers to any protein that is involved in the Base Excision Repair pathway. BERAP may also be referred to as "BER protein". In some examples, the BERAP is an enzyme functioning in one or more steps of the BER pathway; in other examples, the BERAP is a co-factor or a scaffold protein of enzymes functioning in the BER pathway. Scaffold proteins are understood to be proteins which regulate the function or activity of other proteins or pathways by interacting or binding with one or more members of the pathways. In some cases, a scaffold protein may tether multiple members of a pathway into complexes. BERAPs can be identified by referring to proteins listed in the KEGG (Kyoto Encyclopedia of Genes and Genomes) BER pathway (https://www.genome.jp/kegg•bin/show_pathway?map=ko03410), or by searching the term 'base excision repair' in protein databases such as Uniprot (www.uniprot.org).

In some examples of the fusion protein or protein complex as disclosed herein, the BERAP is selected from the group including but not limited to: an AP endonuclease, an end processing enzyme, a catalytically inactive DNA polymerase, a lyase domain, a Flap endonuclease, a DNA ligase, and a scaffold protein involved in the BER pathway. In some examples, the BERAP is selected from the group including but not limited to: a DNA ligase III (LIG3), an XRCC1, a DNA binding or lyase domain of DNA Polymerase beta (PB), a DNA binding or lyase domain of DNA Polymerase delta, a DNA binding or lyase domain of DNA Polymerase epsilon, an AP endonuclease (APE1), Proliferating cell nuclear antigen (PCNA), DNA-(apurinic or apyrimidinic site) lyase (APEX), Poly (ADP-ribose) polymerase (PARP), Flap endonuclease 1 (FEN1), and DNA ligase I (LIG1). In one example, the BERAP is an XRCC1. In some examples, the BERAP is a rat XRCC1 (rXRCC1) or a variant thereof. In some examples, the BERAP is a human XRCC1 (hXRCC1) or a variant thereof. In one example, the BERAP is a rXRCC1 with the amino acid sequence of SEQ ID NO: 4. In one example, the BERAP is a hXRCC1 with the amino acid sequence of SEQ ID NO: 5.

In some examples of the fusion protein or protein complex as disclosed herein, the BERAP is a DNA binding or lyase domain of DNA Polymerase beta (POLB, or PB). In some specific examples, the DNA binding or lyase domain of DNA Polymerase beta corresponds to a region contained within amino acids 1-140, 1-120, 1-100, or 1-87 of the full DNA Polymerase beta sequence. In one example, the DNA binding or lyase domain of DNA Polymerase beta corresponds to a region contained within amino acids 1-140, 1-120, 1-100, or 1-87 of the full human DNA Polymerase beta sequence (SEQ ID NO: 12). In another example, the DNA binding or lyase domain of DNA Polymerase beta corresponds to a region contained within amino acids 1-140, 1-120, 1-100, or 1-87 of the full rat DNA Polymerase beta sequence (SEQ ID NO: 13). In some examples, the BERAP is a human DNA binding or lyase domain of DNA Polymerase beta (PB) or a variant thereof. In some examples, the BERAP is a rat DNA binding or lyase domain of DNA Polymerase beta (PB) or a variant thereof. In one example, the BERAP is a DNA binding or lyase domain of rat Polymerase beta (rPB), with an amino acid sequence of SEQ ID NO: 6. In one example, the BERAP is a DNA binding or lyase domain of rat Polymerase beta (rPB), with an amino acid sequence of SEQ ID NO: 7. In another example, the BERAP is a DNA binding or lyase domain of human Polymerase beta (hPB), with an amino acid sequence of SEQ ID NO: 8. In another example, the BERAP is a DNA binding or lyase domain of human Polymerase beta (hPB), with an amino acid sequence of SEQ ID NO: 9.

In some examples of the fusion protein or protein complex as disclosed herein, the BERAP is a DNA Ligase III (LIG3). In one example, the BERAP is a rat DNA Ligase III (LIG3), with an amino acid sequence of SEQ ID NO: 10. In another example, the BERAP is a human DNA Ligase III (LIG3), with an amino acid sequence of SEQ ID NO: 11.

Nucleobase Modifying Proteins (NMP)

The term "nucleobase modifying protein (NMP)" refers to any protein domain that is capable of modifying a nucleobase (such as adenine (A), cytosine (C), guanine (G), thymine (T), and uracil (U)). The modification can be any chemical or physical changes to the nucleobase, and the NMP includes but not limited to a deaminase, a nuclease, a nickase, a recombinase, a methyltransferase, a methylase, an acetylase, and an acetyltransferase.

In some examples of the fusion protein or protein complex as disclosed herein, the nucleobase modifying protein (NMP) is a cytosine deaminase domain. A cytosine deaminase domain is the functional domain of a cytosine deaminase that has deaminase activity. As the deamination occurs on the cytosine nucleobase that is comprised in a cytidine or deoxycytidine, a cytidine deaminase may also be referred to as a cytosine deaminase. In the present disclosure, the terms "cytidine deaminase" is used interchangeably with "cytosine deaminase". For example, the apolipoprotein B mRNA-editing complex (APOBEC) family of deaminases are conventionally referred to as cytidine deaminases, but they are capable of deaminating the cytosine in cytidine or deoxycytidine. Accordingly, the deaminase domain from an APOBEC cytidine deaminase protein can also be referred to as a cytosine deaminase domain. Therefore in some examples, the cytidine deaminase domain is a deaminase domain from an apolipoprotein B mRNA-editing complex (APOBEC) family deaminase. In some examples, the APOBEC family deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, APOBEC3H deaminase, and any derivatives thereof. In some examples, the cytidine deaminase domain is an activation-induced deaminase (AID). In some examples, the cytidine deaminase domain is a cytidine deaminase 1 from *Petromyzon marinus* (pmCDA1). In some examples, the cytidine deaminase domain has a higher activity on methylated Cs. In some examples, the cytidine deaminase domain has a narrower targeting window.

The Exclusion of Uracil Binding Protein

The fusion protein or a protein complex as disclosed herein does not comprise a Uracil binding protein. As used herein, the term "uracil binding protein" or "UBP" refers to a protein that is capable of binding to uracil. In some examples, the UBP is a uracil modifying enzyme, a uracil base excision enzyme or a uracil DNA glycosylase (UDG or UNG). Therefore, while uracil DNA glycosylase is considered to be involved in the BER pathway and is responsible for removing the creating the abasic site, it is not comprised in the fusion protein or a protein complex (the CGBE) as defined in claim 1. Without being bound by theory, the presence of a uracil binding protein (such as UDG) as a component of the CGBE may maintain the abasic site (created by the removal of the uracil base) and hinder the downstream BER pathway which repairs the abasic site. The CGBE of the present disclosure is designed to promote the Base Excision Repair (BER) pathway, it does not comprise a uracil binding protein.

Architecture of the CGBEs

In some examples of the fusion protein or a protein complex as disclosed herein, the DNA binding protein (DnaBP) is a nickase Cas protein such as nCas9; the Base Excision Repair associated protein (BERAP) is selected from the group consisting of an XRCC1, a DNA Ligase III (LIG3), and a DNA binding or lyase domain of DNA Polymerase beta; and the nucleobase modifying protein (NMP) is a deaminase domain from an apolipoprotein B mRNA-editing complex (APOBEC) family deaminase. In some examples, the DNA binding protein (DnaBP) is a nickase Cas9 (nCas9); the Base Excision Repair associated protein (BERAP) an XRCC1; and the nucleobase modifying protein (NMP) is a deaminase domain from an apolipoprotein B mRNA-editing complex (APOBEC) family deaminase. In some examples, the DNA binding protein (DnaBP) is a nickase Cas9 (nCas9); the Base Excision Repair associated protein (BERAP) is a DNA binding or lyase domain of DNA Polymerase beta; wherein the nucleobase modifying protein (NMP) is a deaminase domain from an apolipoprotein B mRNA-editing complex (APOBEC) family deaminase. In some examples, the DNA binding protein (DnaBP) is a nickase Cas9 (nCas9); the Base Excision Repair associated protein (BERAP) is a DNA Ligase III (LIG3); and the nucleobase modifying protein (NMP) is a deaminase domain from an apolipoprotein B mRNA-editing complex (APOBEC) family deaminase.

Different architectures or orientations of the fusion protein as disclosed herein are possible. In some examples of the fusion protein as disclosed herein, the orientation of the DnaBP, NMP and BERAP within the fusion protein is selected from the group consisting of: [NMP]-[DnaBP]-[BERAP], [NMP]-[BERAP]-[DnaBP] and [BERAP]-[NMP]-[DnaBP]; wherein each instance of "]-[" comprises an optional linker. In one example, the orientation of the DnaBP, NMP and BERAP within the fusion protein is [NMP]-[DnaBP]-[BERAP]. In one example, the orientation of the DnaBP, NMP and BERAP within the fusion protein is [NMP]-[DnaBP]-[BE RAP].

The term "linker," as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an adenosine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g. a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 20-30, 30-40, 40-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 101), which may also be referred to as the XTEN linker. In some embodiments, a linker comprises the amino acid sequence SGGS (SEQ ID NO: 102). In some embodiments, a linker comprises SGGSGGGS (SEQ ID NO: 103), GGGGS (SEQ ID NO: 104), G, EAAAK (SEQ ID NO: 105), GGS, SGSETPGTSESATPES (SEQ ID NO: 101) or XP motif, or a combination of any of these. In some embodiments, a linker comprises repeats of SGGSGGGS (SEQ ID NO: 103), GGGGS (SEQ ID NO: 104), G, EAAAK (SEQ ID NO: 105), GGS, or XP, wherein the repeats is denoted by n, wherein n is independently an integer between 1 and 30, and wherein X is any amino acid. In some embodiments, n is 1, 2, 3, 4, 5, 6, 7, 8, 9, 10, 11, 12, 13, 14, or 15.

In another aspect, the present disclosure provides a fusion protein comprising:

- a first amino acid sequence that is at least 80%, 85%, 86%, 87%, 88%, 89%, 90%, 91%, 92%, 93%, 94%, 95%, 96%, 97%, or 99% identical to the amino acid sequence of any one of SEQ ID NOs: 1-2,
- a second amino acid sequence that is at least 80%, 85%, 86%, 87%, 88%, 89%, 90%, 91%, 92%, 93%, 94%, 95%, 96%, 97%, or 99% identical to the amino acid sequence of SEQ ID NO: 3,
- a third amino acid sequence that is at least 80%, 85%, 86%, 87%, 88%, 89%, 90%, 91%, 92%, 93%, 94%, 95%, 96%, 97%, or 99% identical to the amino acid sequence of SEQ ID NO: 4-11.

In one example of the fusion protein as disclosed herein, the fusion protein comprises one of the below structures:

- [second amino acid sequence]-[first amino acid sequence]-[third amino acid sequence];
- [second amino acid sequence]-[third amino acid sequence]-[first amino acid sequence];
- [first amino acid sequence]-[second amino acid sequence]-[third amino acid sequence];
- [first amino acid sequence]-[third amino acid sequence]-[second amino acid sequence];
- [third amino acid sequence]-[first amino acid sequence]-[second amino acid sequence];
- [third amino acid sequence]-[second amino acid sequence]-[first amino acid sequence];
- wherein each instance of"]-[" comprises an optional linker.

In one example of the fusion protein as disclosed herein, any linker is independently 1-50 amino acids in length. In one example of the fusion protein as disclosed herein, any linker is independently 1-25 amino acids in length. In one example of the fusion protein as disclosed herein, any linker is independently 5-20 amino acids in length. In one example of the fusion protein as disclosed herein, any linker is independently 10, 11, 12, 13, 14, 15, 16, 17, 18, 19, or 20 amino acids in length.

In one example of the fusion protein as disclosed herein, any linker independently comprises one or more amino acid sequences selected from the group consisting of: SGSETPGTSESATPES (XTEN linker) (SEQ ID NO:101, SGGS (SEQ ID NO:102) and GGGGS (SEQ ID NO:104).

In another aspect, the present disclosure provides a protein complex comprising:

- a first protein comprising an amino acid sequence that is at least 80%, 85%, 86%, 87%, 88%, 89%, 90%, 91%, 92%, 93%, 94%, 95%, 96%, 97%, or 99% identical to the amino acid sequence of any one of SEQ ID NOs: 1-2,
- a second protein comprising an amino acid sequence that is at least 80%, 85%, 86%, 87%, 88%, 89%, 90%, 91%, 92%, 93%, 94%, 95%, 96%, 97%, or 99% identical to the amino acid sequence of SEQ ID NO: 3,
- a third protein comprising an amino acid sequence that is at least 80%, 85%, 86%, 87%, 88%, 89%, 90%, 91%, 92%, 93%, 94%, 95%, 96%, 97%, or 99% identical to the amino acid sequence of SEQ ID NO: 4-10.

In some examples, the fusion protein as disclosed herein comprises an amino acid sequence selected from the group consisting of: SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, and SEQ ID NO:72. In one example, the fusion protein as disclosed herein has an amino acid sequence of SEQ ID NO: 44. In another example, the fusion protein as disclosed herein has an amino acid sequence of SEQ ID NO: 48. In another example, the fusion protein as disclosed herein has an amino acid sequence of SEQ ID NO: 69. In another example, the fusion protein as disclosed herein has an amino acid sequence of SEQ ID NO: 70.

In another aspect, the present disclosure provides a protein-nucleic acid complex comprising a nucleic acid molecule and any one of:

- the fusion protein or protein complex as disclosed herein,
- the fusion protein as disclosed herein; and
- the protein complex as disclosed herein.

In one example of the protein-nucleic acid complex as disclosed herein, the nucleic acid molecule is an RNA. In some examples, the RNA is a guide RNA (gRNA), or more specifically a single guide RNA (sgRNA). In some examples, the single guide RNA (sgRNA) as disclosed herein comprises a sequence selected from the group consisting of: SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40 and SEQ ID NO:41.

As used herein, the term "protein-nucleic acid complex" means a complex unit that is a combination of at least one protein and at least one nucleic acid formed by an interaction, including an interaction between the protein and the nucleic acid. Typically, "protein-nucleic acid complexes" are formed by, but not necessarily, the binding of proteins and nucleic acids through non-covalent affinity. In some examples, the gene editing complex is a protein-nucleic acid complex such as a ribonucleoprotein (RNP). A non-limiting example of an RNP is CRISPR-Cas RNP that includes a Cas protein and gRNA.

In one example of the protein-nucleic acid complex as disclosed herein, the nucleic acid molecule comprises a sequence which is about 80%, 90%, or 95% identical or reverse complementary to any of the target sequences listed in Table 2. In some examples, the nucleic acid molecule comprises a sequence which is identical or reverse complementary to any of the target sequences listed in Table 2.

TABLE 2

Target protospacer sequences of exemplary guide RNAs which are used to effect C to G conversions in disease associated genes.

| SEQ ID NO. | Name | Target Sequences and PAMs |
|---|---|---|
| 73 | EMX1 | GAGTCCGAGCAGAAGAAGAA**GGG** |
| 74 | FANCF | GGAATCCCTTCTGCAGCACC**TGG** |
| 75 | HEK2-1 | GAACACAAAGCATAGACTGC**GGG** |
| 76 | HEK2-2 | GAGCACCACACCCTAAACTA**TGG** |
| 77 | HEK2-3 | GGAAACGGATAGTTCTGAAA**GGG** |
| 78 | HEK2-4 | CTTAACTATTTGTATTCCAC**TGG** |
| 79 | HEK2-5 | CTTCCCAAGTGAGAAGCCAG**TGG** |
| 80 | HEK2-6 | CCAGCCCGCTGGCCCTGTAA**AGG** |
| 81 | HEK2-7 | CATTCCGTTATTTTACATAT**TGG** |
| 82 | HEK2-8 | GTTTCCTTTACAGGGCCAGC**GGG** |
| 83 | HEK2-9 | ATACGCACAGTTTGACAGAT**GGG** |
| 84 | HEK2-10 | GCTGGCCCTGTAAAGGAAAC**TGG** |
| 85 | HEK2-11 | GCATGCGTGTGTGTTTAAGC**TGG** |
| 86 | HEK2-12 | TTGGGCTGCAGTAACTTGAA**GGG** |
| 87 | HEK2-13 | TCTTTCAAGCAGGTGATTAC**AGG** |
| 88 | HEK2-14 | AGTTTCCTTTACAGGGCCAG**CGG** |
| 89 | HEK2-15 | GAGGTCGTGGCTGAGCACAA**GGG** |
| 90 | HEK2-16 | GGCCTCTATTGTTGGTAGAA**TGG** |
| 91 | HEK3 | GGCCCAGACTGAGCACGTGA**TGG** |
| 92 | HEK4 | GGCACTGCGGCTGGAGGTGG**GGG** |
| 93 | RNF2-1 | GTCATCTTAGTCATTACCTG**AGG** |
| 94 | RNF2-2 | CACACACACTTAGAATCTGT**GGG** |
| 95 | RNF2-3 | ACACACACACTTAGAATCTG**TGG** |
| 96 | GJB2 | GGACACGAAGATCAGCTGCA**GGG** |
| 97 | ADRB2 | CCCTTTCCTGCGTGACGTCG**TGG** |
| 98 | MYBPC3 | CCCTTTCCTGCGTGACGTCG**TGG** |
| 99 | GAL 292 | GAAGTCGTTGTCAAACAGGA**AGG** |
| 100 | VEGFA-1 | GATGTCTGCAGGCCAGATGA**GGG** |

Targeted C's are underlined.
PAMs are in bold.

In another aspect, the present disclosure provides a method of replacing a cytosine with a guanine on a DNA strand in a cell, said method comprises introducing to the cell the fusion protein or protein complex as disclosed herein, the fusion as disclosed herein, the protein complex as disclosed herein, or the protein-nucleic acid complex as disclosed herein.

In some examples, the cell is a eukaryotic cell. In some examples, the cell is an animal cell. In some specific examples, the cell is a human cell. In some examples, the method is performed in vivo or in vitro.

In some examples, the BERAP and the NMP interact with the same strand of a target DNA molecule.

In another aspect, the present disclosure provides a vector comprising the polynucleotide as disclosed herein.

In another aspect, the present disclosure provides a kit comprising the fusion protein or protein complex as disclosed herein, the fusion protein as disclosed herein, the protein complex as disclosed herein, or the protein-nucleic acid complex as disclosed herein.

In another aspect, the present disclosure provides a cell comprising the fusion protein or protein complex as disclosed herein, the fusion protein as disclosed herein, the protein complex as disclosed herein, or the protein-nucleic acid complex as disclosed herein.

In another aspect, the present disclosure provides a cell comprising one or more nucleic acid molecules that encode the fusion protein or protein complex as disclosed herein, the fusion protein as disclosed herein, the protein complex as disclosed herein, or the protein-nucleic acid complex as disclosed herein.

In another aspect, the present disclosure provides a method of treating a subject having or suspected of having a disease or disorder comprising administering the fusion protein or protein complex as disclosed herein, the fusion protein as disclosed herein, the protein complex as disclosed herein, or the protein-nucleic acid complex as disclosed herein, the pharmaceutical composition as disclosed herein, the polynucleotide as disclosed herein, or the vector as disclosed herein to the subject. In one example, the disease or disorder comprises one or more C to G (C>G) mutations. In another example, the disease or disorder comprises one or more G to C (G>C) mutations. In another example, the disease or disorder comprises C>G and G>C mutations. In one example, the disease or disorder is inclusive of, but not limited to any of the conditions listed in https://www.ncbi.nlm.nih.gov/clinvar/?term=C%3EG or https://www.ncbi.nlm.nih.gov/clinvar/?term=G%3EC, and filtering based on the selection of the following clinical significance: pathogenic, risk factor or likely pathogenic. In one example, the disease or disorder is selected from a group consisting of skin fibrosis, bladder cancer, liver cancer, Myasthenic syndrome, Spondyloepimetaphyseal dysplasia, Parkinson's disease, Deafness, blood disorders, and Schnyder crystalline corneal dystrophy.

In another aspect, the present disclosure provides a fusion protein or protein complex as disclosed herein, the fusion protein as disclosed herein, the protein complex as disclosed herein, or the protein-nucleic acid complex as disclosed herein, the pharmaceutical composition as disclosed herein, the polynucleotide as disclosed herein, or the vector as disclosed herein for use in treating a subject having or suspected of having a disease or disorder. In one example, the disease or disorder comprises one or more C to G (C>G) mutations. In another example, the disease or disorder comprises one or more G to C (G>C) mutations. In another example, the disease or disorder comprises C>G and G>C mutations. In one example, the disease or disorder is inclusive of, but not limited to any of the conditions listed in https://www.ncbi.nlm.nih.gov/clinvar/?term=C%3EG or https://www.ncbi.nlm.nih.gov/clinvar/?term=G%3EC, and filtering based on the selection of the following clinical significance: pathogenic, risk factor or likely pathogenic. In one example, the disease or disorder is selected from a group consisting of skin fibrosis, bladder cancer, liver cancer, Myasthenic syndrome, Spondyloepimetaphyseal dysplasia, Parkinson's disease, Deafness, blood disorders, and Schnyder crystalline corneal dystrophy.

In another aspect, the present disclosure provides a fusion protein or protein complex as disclosed herein, the fusion protein as disclosed herein, the protein complex as disclosed herein, or the protein-nucleic acid complex as disclosed herein, the pharmaceutical composition as disclosed herein, the polynucleotide as disclosed herein, or the vector as disclosed herein in the manufacture of a medicament for treating a subject having or suspected of having a disease or disorder. In one example, the disease or disorder comprises one or more C to G (C>G) mutations. In another example, the disease or disorder comprises one or more G to C (G>C) mutations. In another example, the disease or disorder comprises C>G and G>C mutations. In one example, the disease or disorder is inclusive of, but not limited to any of the conditions listed in https://www.ncbi.nlm.nih.gov/clinvar/?term=C%3EG or https://www.ncbi.nlm.nih.gov/clinvar/?term=G%3EC, and filtering based on the selection of the following clinical significance: pathogenic, risk factor or likely pathogenic. In one example, the disease or disorder is selected from a group consisting of skin fibrosis, bladder cancer, liver cancer, Myasthenic syndrome, Spondyloepimetaphyseal dysplasia, Parkinson's disease, Deafness, blood disorders, and Schnyder crystalline corneal dystrophy.

In another aspect, the present disclosure provides a method for editing a target nucleobase pair of a double-stranded DNA sequence, the method comprising:

a. contacting a target region of the double-stranded DNA sequence with a complex comprising a nucleobase editor and a guide nucleic acid, wherein the target region comprises the target nucleobase pair;
b. inducing strand separation of said target region;
c. converting a first nucleobase of said target nucleobase pair in a single strand of the target region to a second nucleobase;
d. excising said second nucleobase from the double-stranded DNA sequence to produce an abasic site; and
e. promoting the Base Excision Repair (BER) pathway to repair the abasic site, generating a third nucleobase at the abasic site, wherein the third nucleobase is different from the first nucleobase.

In one example, the method as disclosed herein further comprises converting a fourth nucleobase that is complementary to the third nucleobase, thereby generating an intended edited base pair.

In one example of the method as disclosed herein, the efficiency of generating the intended edited base pair is at least 5%, at least 10%, at least 15%, at least 20%, at least 25%, at least 35%, at least 40%, at least 45% or at least 50%.

In one example of the method as disclosed herein, the ratio of intended edited base pairs to unintended edited base pairs is at least 2:1, at least 3:1, at least 4:1, at least 5:1, at least 6:1, at least 7:1, at least 8:1, at least 9:1, or at least 10:1.

In one example of the method as disclosed herein, the first nucleobase is cytosine. In one example of the method as disclosed herein, the second nucleobase is uracil. In one example of the method as disclosed herein, the third nucleobase is guanine. In one example of the method as disclosed herein, the fourth nucleobase is cytosine.

In some examples of the method as disclosed herein, the nucleobase editor comprises nickase activity.

In some examples of the method as disclosed herein, the target region is 5-40, 5-30, 5-20, or 20 amino acids in length.

In some examples of the method as disclosed herein, the intended edited base pair resides within or proximal to the CGBE-binding site (protospacer). In some examples, the intended edited base pair is located 1, 2, 3, 4, 5, 6, 7, 8, 9, 10, 11, 12, 13, 14, 15, 16, 17, 18, 19, or 20 nucleotides upstream, within, or downstream of the CBGE-binding site. In some examples, the intended edited base pair is upstream of a protospacer adjacent motif (PAM) site. In some examples, the intended edited base pair is located 1, 2, 3, 4, 5, 6, 7, 8, 9, 10, 11, 12, 13, 14, 15, 16, 17, 18, 19, or 20 nucleotides upstream of the PAM site. As used herein, the protospacer adjacent motif (or PAM for short) is a short DNA sequence (usually 2-6 base pairs in length) that follows the DNA region targeted for cleavage by the CRISPR system, such as CRISPR-Cas9 (which has the PAM site sequence of NGG). In some examples, the intended edited base pair is located 14, 15, or 16 or 17 nucleotides upstream of the PAM site. Unless explicitly stated otherwise, the term "upsteam of the PAM site" describes nucleotides/base pairs to the 5' direction of the PAM site, on the non-complementary strand (the strand not bound by the guide RNA).

In some examples of the method as disclosed herein, the intended edited base pair is downstream of a protospacer adjacent motif (PAM) site. In some examples, the intended edited base pair is located 1, 2, 3, 4, 5, 6, 7, 8, 9, 10, 11, 12, 13, 14, 15, 16, 17, 18, 19, or 20 nucleotides downstream of the PAM site. As used herein, the protospacer adjacent motif (or PAM for short) is a short DNA sequence (usually 2-6 base pairs in length) that follows the DNA region targeted for cleavage by the CRISPR system, such as CRISPR-Cas9 (which has the PAM site sequence of NGG). In some examples, the intended edited base pair is located 14, 15, 16, 17, 18, 19 or 20 nucleotides downstream of the PAM site. Unless explicitly stated otherwise, the term "downstream of the PAM site" describes nucleotides/base pairs to the 3' direction of the PAM site, on the non-complementary strand (the strand not bound by the guide RNA).

In some examples of the method as disclosed herein, the nucleobase editor comprises a linker. In some examples, the linker is 1-25, 5-20, 10-15 amino acids in length.

In some examples of the method as disclosed herein, the target region comprises a target window, wherein the target window comprises the target nucleobase pair. As used herein, the target region is a region on double-stranded DNA sequence which the fusion protein or protein complex (the CGBE) is designed to recognize or bind with. In examples wherein the DNA binding protein is guided by a guide RNA (such is the case for the Cas family proteins), the target region may be the region bound by the guide RNA. As used herein, the target window refers to a sequence window within the target region that is subject to efficient C to G editing of the CBGE. For optimal C to G editing, the target "C" is ideally located within the targeting window. In some examples, the target window is 1, 2, 3, 4, 5, 6, 7, 8, 9, 10, 11, 12, 13, 14, 15, 16, 17, 18, 19, or 20 nucleotides in length. In some examples, the target window is 3, 4, 5, 6, or 7 nucleotides in length. In some examples, the target window comprises the 14th, 15th, 16th and 17th nucleotides upstream of the PAM site. In one example, the target window is the 15th nucleotides upstream of the PAM site.

In some examples of the method as disclosed herein, the nucleobase editor comprises the fusion protein or protein complex as disclosed herein, the fusion protein as disclosed herein, or the protein complex as disclosed herein.

In some examples of the method as disclosed herein, the first nucleobase of the target nucleobase pair is a cytosine, and wherein said cytosine is in a DNA motif characterized by any one of the group consisting of WCW, ACC and GCT; wherein "C" is said Cytosine, W indicates an Adenine(A) or a Thymine (T).

In some examples, the method as disclosed herein is performed in vivo or in vitro.

TABLE 3

Sequence listing table

| SEQ ID NO: | Name | Sequence |
|---|---|---|
| 1 | nCas9 (Cas9 nickase) | MDKKYSIGLAIGTNSVGWAVITDEYKVPSKKFKVLGNTDRHSIKKN<br>LIGALLFDSGETAEATRLKRTARRRYTRRKNRICYLQEIFSNEMAK<br>VDDSFFHRLEESFLVEEDKKHERHPIFGNIVDEVAYHEKYPTIYHL<br>RKKLVDSTDKADLRLIYLALAHMIKFRGHFLIEGDLNPDNSDVDKLF<br>IQLVQTYNQLFEENPINASGVDAKAILSARLSKSRRLENLIAQLPGE<br>KKNGLFGNLIALSLGLTPNFKSNFDLAEDAKLQLSKDTYDDDLDNL<br>LAQIGDQYADLFLAAKNLSDAILLSDILRVNTEITKAPLSASMIKRYD<br>EHHQDLTLLKALVRQQLPEKYKEIFFDQSKNGYAGYIDGGASQEE<br>FYKFIKPILEKMDGTEELLVKLNREDLLRKQRTFDNGSIPHQIHLGE<br>LHAILRRQEDFYPFLKDNREKIEKILTFRIPYYVGPLARGNSRFAWM<br>TRKSEETITPWNFEEVVDKGASAQSFIERMTNFDKNLPNEKVLPK<br>HSLLYEYFTVYNELTKVKYVTEGMRKPAFLSGEQKKAIVDLLFKTN<br>RKVTVKQLKEDYFKKIECFDSVEISGVEDRFNASLGTYHDLLKIIKD<br>KDFLDNEENEDILEDIVLTLTLFEDREMIEERLKTYAHLFDDKVMKQ<br>LKRRRYTGWGRLSRKLINGIRDKQSGKTILDFLKSDGFANRNFMQ<br>LIHDDSLTFKEDIQKAQVSGQGDSLHEHIANLAGSPAIKKGILQTVK<br>VVDELVKVMGRHKPENIVIEMARENQTTQKGQKNSRERMKRIEEG<br>IKELGSQILKEHPVENTQLQNEKLYLYYLQNGRDMYVDQELDINRL<br>SDYDVDHIVPQSFLKDDSIDNKVLTRSDKNRGKSDNVPSEEVVKK<br>MKNYWRQLLNAKLITQRKFDNLTKAERGGLSELDKAGFIKRQLVE<br>TRQITKHVAQILDSRMNTKYDENDKLIREVKVITLKSKLVSDFRKDF<br>QFYKVREINNYHHAHDAYLNAVVGTALIKKYPKLESEFVYGDYKVY<br>DVRKMIAKSEQEIGKATAKYFFYSNIMNFFKTEITLANGEIRKRPLIE<br>TNGETGEIVWDKGRDFATVRKVLSMPQVNIVKKTEVQTGGFSKES |

TABLE 3-continued

Sequence listing table

| SEQ ID NO: | Name | Sequence |
|---|---|---|
| | | ILPKRNSDKLIARKKDWDPKKYGGFDSPTVAYSVLVVAKVEKGKS KKLKSVKELLGITIMERSSFEKNPIDFLEAKGYKEVKKDLIIKLPKYS LFELENGRKRMLASAGELQKGNELALPSKYVNFLYLASHYEKLKG SPEDNEQKQLFVEQHKHYLDEIIEQISEFSKRVILADANLDKVLSAY NKHRDKPIREQAENIIHLFTLTNLGAPAAFKYFDTTIDRKRYTSTKE VLDATLIHQSITGLYETRIDLSQLGGD |
| 2 | Cas9 (Wildtype) | MDKKYSIGLDIGTNSVGWAVITDEYKVPSKKFKVLGNTDRHSIKKN LIGALLFDSGETAEATRLKRTARRRYTRRKNRICYLQEIFSNEMAK VDDSFFHRLEESFLVEEDKKHERHPIFGNIVDEVAYHEKYPTIYHL RKKLVDSTDKADLRLIYLALAHMIKFRGHFLIEGDLNPDNSDVDKLF IQLVQTYNQLFEENPINASGVDAKAILSARLSKSRRLENLIAQLPGE KKNGLFGNLIALSLGLTPNFKSNFDLAEDAKLQLSKDTYDDDLDNL LAQIGDQYADLFLAAKNLSDAILLSDILRVNTEITKAPLSASMIKRYD EHHQDLTLLKALVRQQLPEKYKEIFFDQSKNGYAGYIDGGASQEE FYKFIKPILEKMDGTEELLVKLNREDLLRKQRTFDNGSIPHQIHLGE LHAILRRQEDFYPFLKDNREKIEKILTFRIPYYVGPLARGNSRFAWM TRKSEETITPWNFEEVVDKGASAQSFIERMTNFDKNLPNEKVLPK HSLLYEYFTVYNELTKVKYVTEGMRKPAFLSGEQKKAIVDLLFKTN RKVTVKQLKEDYFKKIECFDSVEISGVEDRFNASLGTYHDLLKIIKD KDFLDNEENEDILEDIVLTLTLFEDREMIEERLKTYAHLFDDKVMKQ LKRRRYTGWGRLSRKLINGIRDKQSGKTILDFLKSDGFANRNFMQ LIHDDSLTFKEDIQKAQVSGQGDSLHEHIANLAGSPAIKKGILQTVK VVDELVKVMGRHKPENIVIEMARENQTTQKGQKNSRERMKRIEEG IKELGSQILKEHPVENTQLQNEKLYLYYLQNGRDMYVDQELDINRL SDYDVDHIVPQSFLKDDSIDNKVLTRSDKNRGKSDNVPSEEVVKK MKNYWRQLLNAKLITQRKFDNLTKAERGGLSELDKAGFIKRQLVE TRQITKHVAQILDSRMNTKYDENDKLIREVKVITLKSKLVSDFRKDF QFYKVREINNYHHAHDAYLNAVVGTALIKKYPKLESEFVYGDYKVY DVRKMIAKSEQEIGKATAKYFFYSNIMNFFKTEITLANGEIRKRPLIE TNGETGEIVWDKGRDFATVRKVLSMPQVNIVKKTEVQTGGFSKES ILPKRNSDKLIARKKDWDPKKYGGFDSPTVAYSVLVVAKVEKGKS KKLKSVKELLGITIMERSSFEKNPIDFLEAKGYKEVKKDLIIKLPKYS LFELENGRKRMLASAGELQKGNELALPSKYVNFLYLASHYEKLKG SPEDNEQKQLFVEQHKHYLDEIIEQISEFSKRVILADANLDKVLSAY NKHRDKPIREQAENIIHLFTLTNLGAPAAFKYFDTTIDRKRYTSTKE VLDATLIHQSITGLYETRIDLSQLGGD |
| 3 | APOBEC | MSSETGPVAVDPTLRRRIEPHEFEVFFDPRELRKETCLLYEINWG GRHSIWRHTSQNTNKHVEVNFIEKFTTERYFCPNTRCSITWFLSW SPCGECSRAITEFLSRYPHVTLFIYIARLYHHADPRNRQGLRDLISS GVTIQIMTEQESGYCWRNFVNYSPSNEAHWPRYPHLWVRLYVLE LYCIILGLPPCLNILRRKQPQLTFFTIALQSCHYQRLPPHILWATGLK |
| 4 | rXRCC1 | MPEISLRHWSCSSQDSTHRAENLLKADTYRKWRSAKAGEKTISV VLQLEKEEQIHSVDIGNDGSAFVEVLVGSSAGGATAGEQDYEVLL VTSSFMSPSESRSGSNPNRVRIFGPDKLVRAAAEKRWDRVKIVCS QPYSKDSPYGLSFVKFHSPPDKDEAEAPSQKVTVTKLGQFRVKEE DDSANSLRPGALFFNRINKAASASASDPAGPSYAAATLQASSAAS SALPVPKVGGSSSKLQEPPKGKRKLDLGLEDSKPPSKPSAGPAAL KRPKLPVPSRTPAATPASTPAQKAVPGKPRGEGTEPRGARAGPQ ELGKILQGVVVVLSGFQNPFRSELRDKALELGAKYRPDWTPDSTH LICAFANTPKYSQVLGLGGRIVRKEWVLDCYRMRRRLPSRRYLMA GLGSSSEDEGDSHSESGEDEAPKLPRKRPQPKAKTQAAGPSSPP RPPTPEETKAPSPGPQDNSDTDGEQSEGRDNGAEDSGDTEDEL RRVAKQREQRQPPAPEENGEDPYAGSTDENTDSEAPSEADLPIP ELPDFFQGKHFFLYGEFPGDERRKLIRYVTAFNGELEDYMSDRVQ FVITAQEWDPNFEEALMENPSLAFVRPRWIYSCNEKQKLLPHQLY GVVPQA |
| 5 | hXRCC1 | MGPEIRLRHVVSCSSQDSTHCAENLLKADTYRKWRAAKAGEKTIS VVLQLEKEEQIHSVDIGNDGSAFVEVLVGSSAGGAGEQDYEVLLV TSSFMSPSESRSGSNPNRVRMFGPDKLVRAAAEKRWDRVKIVCS QPYSKDSPFGLSFVRFHSPPDKDEAEAPSQKVTVTKLGQFRVKEE DESANSLRPGALFFSRINKTSPVTASDPAGPSYAAATLQASSAASS ASPVSRAIGSTSKPQESPKGKRKLDLNQEEKKTPSKPPAQLSPSV PKRPKLPAPTRTPATAPVPARAQGAVTGKPRGEGTEPRRPRAGP EELGKILQGVVVVLSGFQNPFRSELRDKALELGAKYRPDWTRDST HLICAFANTPKYSQVLGLGGRIVRKEWVLDCHRMRRRLPSQRYLM AGPGSSSEEDEASHSGGSGDEAPKLPQKQPQTKTKPTQAAGPSS PQKPPTPEETKAASPVLQEDIDIEGVQSEGQDNGAEDSGDTEDEL RRVAEQKEHRLPPGQEENGEDPYAGSTDENTDSEEHQEPPDLPV PELPDFFQGKHFFLYGEFPGDERRKLIRYVTAFNGELEDYMSDRV |

TABLE 3-continued

| Sequence listing table | | |
|---|---|---|
| SEQ ID NO: | Name | Sequence |
| | | QFVITAQEWDPSFEEALMDNPSLAFVRPRWIYSCNEKQKLLPHQL<br>YGVVPQA |
| 6 | rPB_8 KD | MSKRKAPQETLNGGITDMLVELANFEKNVSQAIHKYNAYRKAASVI<br>AKYPHKIKSGAEAKKLPGVGTKIAEKIDEFLATGKLRKLEK |
| 7 | rPB_14KD | MSKRKAPQETLNGGITDMLVELANFEKNVSQAIHKYNAYRKAASVI<br>AKYPHKIKSGAEAKKLPGVGTKIAEKIDEFLATGKLRKLEKIRQDDT<br>SSSINFLTRVTGIGPSAARKLVDEGIKTLEDLRKNEDKLNHHQRIGL<br>K |
| 8 | hPBI_8 KD | MSKRKAPQETLNGGITDMLTELANFEKNVSQAIHKYNAYRKAASVI<br>AKYPHKIKSGAEAKKLPGVGTKIAEKIDEFLATGKLRKLEK |
| 9 | hPBI_14 KD | MSKRKAPQETLNGGITDMLTELANFEKNVSQAIHKYNAYRKAASVI<br>AKYPHKIKSGAEAKKLPGVGTKIAEKIDEFLATGKLRKLEKIRQDDT<br>SSSINFLTRVSGIGPSAARKFVDEGIKTLEDLRKNEDKLNHHQRIGL<br>K |
| 10 | rLIG3 | MTLAFKTLFPRNLCALGRKELCLFSEQHHWPAIRQFSQWSETNLL<br>CGCCLLQRRKPVLSFQRGHLRPRATHLISWSGSHVGLCTGPCEM<br>AEQRFCVDYAKRGTAGCKKCKEKIVKGVCRIGKVVPNPFSESGG<br>DMKEWYHIKCMFEKLERARATTKKIEDLTELEGWEELEDNEKEQI<br>SQHIADLSSKTAATPKKKATVQAKLTTTGQVTSPVKGASFITSTNP<br>RKFSGFSAAKPNNSEQDPSSPAPKTSLSASKCDPKHKDCLLREFR<br>KLCAMVAENPSYNTKTQIIHDFLQKGSTGDGFRGDVYLTVKLLLPG<br>VIKSVYNLNDKQIVKLFSRIFNCNPDDMARDLEQGDVSETIRVFFE<br>QSKSFPPAAKSLLTIQEVDAFLLHLSKLTKEDEQQQALQDIASRCT<br>ANDLKCIIRLIKHDLKMNSGAKHVLDALDPNAYEAFKASRNLQDVV<br>ERVLHNEQEVEKDPGRRRALSVQASLMTPVQPMLAEACKSIEYA<br>MKKCPNGMFSEIKYDGERVQVHKKGDHFSYFSRSLKPVLPHKVA<br>HFKDYIPKAFPGGQSMILDSEVLLIDNNTGKPLPFGTLGVHKKAAF<br>QDANVCLFVFDCIYFNDVSLMDRPLCERRKFLHDNMVEIRNRIMF<br>SEMKQVTKASDLADMINRVIREGLEGLVLKDVKGTYEPGKRHWLK<br>VKKDYLNEGAMADTADLVVLGAFYGQGSKGGMMSIFLMGCYDPD<br>SQKWCTVTKCAGGHDDATLARLQKELDMVKISKDPSKIPSWLKIN<br>KIYYPDFIVPDPKKAAVWEITGAEFSRSEAHTADGISIRFPRCTRIR<br>DDKDWKSATNLPQLKELYQLSKDKADFAVVAGDEGSSTTGGSNG<br>ENEGTAGSTVPRKGPKGPPSKSSASAKKTEQKLNDPSSRGGEKL<br>AVKSSPVKVGMKRKAADETPGLTKRRRASRQRGRRAMRTGRR |
| 11 | hLIG3 | MSKAAGTPKKKAVVQAKLTTTGQVTSPVKGASFVTSTNPRKFSGF<br>SAKPNNSGEAPSSPTPKRSLSSSKCDPRHKDCLLREFRKLCAMV<br>ADNPSYNTKTQIIQDFLRKGSAGDGFHGDVYLTVKLLLPGVIKTVY<br>NLNDKQIVKLFSRIFNCNPDDMARDLEQGDVSETIRVFFEQSKSFP<br>PAAKSLLTIQEVDEFLLRLSKLTKEDEQQQALQDIASRCTANDLKCI<br>IRLIKHDLKMNSGAKHVLDALDPNAYEAFKASRNLQDVVERVLHNA<br>QEVEKEPGQRRALSVQASLMTPVQPMLAEACKSVEYAMKKCPN<br>GMFSEIKYDGERVQVHKNGDHFSYFSRSLKPVLPHKVAHFKDYIP<br>QAFPGGHSMILDSEVLLIDNKTGKPLPFGTLGVHKKAAFQDANVCL<br>FVFDCIYFNDVSLMDRPLCERRKFLHDNMVEIPNRIMFSEMKRVTK<br>ALDLADMITRVIQEGLEGLVLKDVKGTYEPGKRHWLKVKKDYLNE<br>GAMADTADLVVLGAFYGQGSKGGMMSIFLMGCYDPGSQKWCTV<br>TKCAGGHDDATLARLQNELDMVKISKDPSKIPSWLKVNKIYYPDFI<br>VPDPKKAAVWEITGAEFSKSEAHTADGISIRFPRCTRIRDDKDWKS<br>ATNLPQLKELYQLSKEKADFTVVAGDEGSSTTGGSSEENKGPSG<br>SAVSRKAPSKPSASTKKAEGKLSNSNSKDGNMQTAKPSAMKVGE<br>KLATKSSPVKVGEKRKAADETLCQTKVLLDIFTGVRLYLPPSTPDF<br>SRLRRYFVAFDGDLVQEFDMTSATHVLGSRDKNPAAQQVSPEWI<br>WACIRKRRLVAPC |
| 12 | Full amino acid sequence of human DNA polymerase beta (PB) (M at start of protein sequence is removed to fuseto Cas9) | MSKRKAPQETLNGGITDMLTELANFEKNVSQAIHKYNAYRKAASVI<br>AKYPHKIKSGAEAKKLPGVGTKIAEKIDEFLATGKLRKLEKIRQDDT<br>SSSINFLTRVSGIGPSAARKFVDEGIKTLEDLRKNEDKLNHHQRIGL<br>KYFGDFEKRIPREEMLQMQDIVLNEVKKVDSEYIATVCGSFRRGA<br>ESSGDMDVLLTHPSFTSESTKQPKLLHQVVEQLQKVHFITDTLSK<br>GETKFMGVCQLPSKNDEKEYPHRRIDIRLIPKDQYYCGVLYFTGS<br>DIFNKNMRAHALEKGFTINEYTIRPLGVTGVAGEPLPVDSEKDIFDY<br>IQWKYREPKDRSE |

TABLE 3-continued

Sequence listing table

| SEQ ID NO: | Name | Sequence |
|---|---|---|
| 13 | Full amino acid sequence of rat DNA polymerase beta (PB) (M at start of protein sequence is removed to fuseto Cas9) | MSKRKAPQETLNGGITDMLVELANFEKNVSQAIHKYNAYRKAASVI AKYPHKIKSGAEAKKLPGVGTKIAEKIDEFLATGKLRKLEKIRQDDT SSSINFLTRVTGIGPSAARKLVDEGIKTLEDLRKNEDKLNHHQRIGL KYFEDFEKRIPREEMLQMQDIVLNEVKKLDPEYIATVCGSFRRGAE SSGDMDVLLTHPNFTSESSKQPKLLHRVVEQLQKVRFITDTLSKG ETKFMGVCQLPSENDENEYPHRRIDIRLIPKDQYYCGVLYFTGSDI FNKNMRAHALEKGFTINEYTIRPLGVTGVAGEPLPVDSEQDIFDYI QWRYREPKDRSE |
| 14 | EMX1 gRNA sequence (spacer is underlined) | GAGTCCGAGCAGAAGAAGAAGTTTTAGAGCTAGAAATAGCAAG TTAAAATAAGGCTAGTCCGTTATCAACTTGAAAAAGTGGCACCG AGTCGGTGC |
| 15 | FANCF gRNA sequence (spacer is underlined) | GGAATCCCTTCTGCAGCACCGTTTTAGAGCTAGAAATAGCAAG TTAAAATAAGGCTAGTCCGTTATCAACTTGAAAAAGTGGCACCG AGTCGGTGC |
| 16 | HEK2-1 gRNA sequence (spacer is underlined) | GAACACAAAGCATAGACTGCGTTTTAGAGCTAGAAATAGCAAGT TAAAATAAGGCTAGTCCGTTATCAACTTGAAAAAGTGGCACCGA GTCGGTGC |
| 17 | HEK2-2 gRNA sequence (spacer is underlined) | GAGCACCACACCCTAAACTAGTTTTAGAGCTAGAAATAGCAAGT TAAAATAAGGCTAGTCCGTTATCAACTTGAAAAAGTGGCACCGA GTCGGTGC |
| 18 | HEK2-3 gRNA sequence (spacer is underlined) | GGAAACGGATAGTTCTGAAAGTTTTAGAGCTAGAAATAGCAAGT TAAAATAAGGCTAGTCCGTTATCAACTTGAAAAAGTGGCACCGA GTCGGTGC |
| 19 | HEK2-4 gRNA sequence (spacer is underlined) | CTTAACTATTTGTATTCCACGTTTTAGAGCTAGAAATAGCAAGTT AAAATAAGGCTAGTCCGTTATCAACTTGAAAAAGTGGCACCGA GTCGGTGC |
| 20 | HEK2-5 gRNA sequence (spacer is underlined) | CTTCCCAAGTGAGAAGCCAGGTTTTAGAGCTAGAAATAGCAAG TTAAAATAAGGCTAGTCCGTTATCAACTTGAAAAAGTGGCACCG AGTCGGTGC |
| 21 | HEK2-6 gRNA sequence (spacer is underlined) | CCAGCCCGCTGGCCCTGTAAGTTTTAGAGCTAGAAATAGCAAG TTAAAATAAGGCTAGTCCGTTATCAACTTGAAAAAGTGGCACCG AGTCGGTGC |
| 22 | HEK2-7 gRNA sequence (spacer is underlined) | CATTCCGTTATTTTACATATGTTTTAGAGCTAGAAATAGCAAGTT AAAATAAGGCTAGTCCGTTATCAACTTGAAAAAGTGGCACCGA GTCGGTGC |
| 23 | HEK2-8 gRNA sequence (spacer is underlined) | GTTTCCTTTACAGGGCCAGCGTTTTAGAGCTAGAAATAGCAAGT TAAAATAAGGCTAGTCCGTTATCAACTTGAAAAAGTGGCACCGA GTCGGTGC |

TABLE 3-continued

| Sequence listing table | | |
|---|---|---|
| SEQ ID NO: | Name | Sequence |
| 24 | HEK2-9 gRNA sequence (spacer is underlined) | ATACGCACAGTTTGACAGATGTTTTAGAGCTAGAAATAGCAAGT TAAAATAAGGCTAGTCCGTTATCAACTTGAAAAAGTGGCACCGA GTCGGTGC |
| 25 | HEK2-10 gRNA sequence (spacer is underlined) | GCTGGCCCTGTAAAGGAAACGTTTTAGAGCTAGAAATAGCAAG TTAAAATAAGGCTAGTCCGTTATCAACTTGAAAAAGTGGCACCG AGTCGGTGC |
| 26 | HEK2-11 gRNA sequence (spacer is underlined) | GCATGCGTGTGTGTTTAAGCGTTTTAGAGCTAGAAATAGCAAGT TAAAATAAGGCTAGTCCGTTATCAACTTGAAAAAGTGGCACCGA GTCGGTGC |
| 27 | HEK2-12 gRNA sequence (spacer is underlined) | TTGGGCTGCAGTAACTTGAAGTTTTAGAGCTAGAAATAGCAAGT TAAAATAAGGCTAGTCCGTTATCAACTTGAAAAAGTGGCACCGA GTCGGTGC |
| 28 | HEK2-13 gRNA sequence (spacer is underlined) | TCTTTCAAGCAGGTGATTACGTTTTAGAGCTAGAAATAGCAAGT TAAAATAAGGCTAGTCCGTTATCAACTTGAAAAAGTGGCACCGA GTCGGTGC |
| 29 | HEK2-14 gRNA sequence (spacer is underlined) | AGTTTCCTTTACAGGGCCAGGTTTTAGAGCTAGAAATAGCAAGT TAAAATAAGGCTAGTCCGTTATCAACTTGAAAAAGTGGCACCGA GTCGGTGC |
| 30 | HEK2-15 gRNA sequence (spacer is underlined) | GAGGTCGTGGCTGAGCACAAGTTTTAGAGCTAGAAATAGCAAG TTAAAATAAGGCTAGTCCGTTATCAACTTGAAAAAGTGGCACCG AGTCGGTGC |
| 31 | HEK2-16 gRNA sequence (spacer is underlined) | GGCCTCTATTGTTGGTAGAAGTTTTAGAGCTAGAAATAGCAAGT TAAAATAAGGCTAGTCCGTTATCAACTTGAAAAAGTGGCACCGA GTCGGTGC |
| 32 | HEK3 gRNA sequence (spacer is underlined) | GGCCCAGACTGAGCACGTGAGTTTTAGAGCTAGAAATAGCAAG TTAAAATAAGGCTAGTCCGTTATCAACTTGAAAAAGTGGCACCG AGTCGGTGC |
| 33 | HEK4 gRNA sequence (spacer is underlined) | GGCACTGCGGCTGGAGGTGGGTTTTAGAGCTAGAAATAGCAA GTTAAAATAAGGCTAGTCCGTTATCAACTTGAAAAAGTGGCACC GAGTCGGTGC |
| 34 | RNF2-1 gRNA sequence (spacer is underlined) | GTCATCTTAGTCATTACCTGGTTTTAGAGCTAGAAATAGCAAGT TAAAATAAGGCTAGTCCGTTATCAACTTGAAAAAGTGGCACCGA GTCGGTGC |
| 35 | RNF2-2 gRNA sequence (spacer is underlined) | CACACACACTTAGAATCTGTGTTTTAGAGCTAGAAATAGCAAGT TAAAATAAGGCTAGTCCGTTATCAACTTGAAAAAGTGGCACCGA GTCGGTGC |

TABLE 3-continued

Sequence listing table

| SEQ ID NO: | Name | Sequence |
|---|---|---|
| 36 | RNF2-3 gRNA sequence (spacer is underlined) | ACACACACACTTAGAATCTGGTTTTAGAGCTAGAAATAGCAAGT<br>TAAAATAAGGCTAGTCCGTTATCAACTTGAAAAAGTGGCACCGA<br>GTCGGTGC |
| 37 | GJB2gRNA sequence (spacer is underlined) | GGACACGAAGATCAGCTGCAGTTTTAGAGCTAGAAATAGCAAG<br>TTAAAATAAGGCTAGTCCGTTATCAACTTGAAAAAGTGGCACCG<br>AGTCGGTGC |
| 38 | ADRB2 gRNA sequence (spacer is underlined) | CCCTTTCCTGCGTGACGTCGGTTTTAGAGCTAGAAATAGCAAG<br>TTAAAATAAGGCTAGTCCGTTATCAACTTGAAAAAGTGGCACCG<br>AGTCGGTGC |
| 39 | MYBPC3 gRNA sequence (spacer is underlined) | CCCTTTCCTGCGTGACGTCGGTTTTAGAGCTAGAAATAGCAAG<br>TTAAAATAAGGCTAGTCCGTTATCAACTTGAAAAAGTGGCACCG<br>AGTCGGTGC |
| 40 | GAL 292 gRNA sequence (spacer is underlined) | GAAGTCGTTGTCAAACAGGAGTTTTAGAGCTAGAAATAGCAAGT<br>TAAAATAAGGCTAGTCCGTTATCAACTTGAAAAAGTGGCACCGA<br>GTCGGTGC |
| 41 | VEGFA-1 gRNA sequence (spacer is underlined) | GATGTCTGCAGGCCAGATGAGTTTTAGAGCTAGAAATAGCAAG<br>TTAAAATAAGGCTAGTCCGTTATCAACTTGAAAAAGTGGCACCG<br>AGTCGGTGC |

In addition to the table above, full amino acid sequences of specific fusion proteins (CGBEs) as disclosed herein are provided in Table 4 below:

| SEQ ID NO: | Name | Sequence |
|---|---|---|
| 42 | Amino acid sequence of ACX, hPB(8 kD) (Apobec is in bold; nCas9 is in parentheses [ ]; hPB(8 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV |

-continued

| SEQ ID NO: | Name | Sequence |
| --- | --- | --- |
| | | KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKRKAPQETLNGGITDMLTELANFEKNVSQAIHKYNAYRKAASVI<br>AKYPHKIKSGAEAKKLPGVGTKIAEKIDEFLATGKLRKLEKSGGSP<br>KKKRKV |
| 43 | Amino acid sequence of ACX, hPB(14 kD) (Apobec is in bold; nCas9 is in parentheses [ ]; hPB(14 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKRKAPQETLNGGITDMLTELANFEKNVSQAIHKYNAYRKAASVI<br>AKYPHKIKSGAEAKKLPGVGTKIAEKIDEFLATGKLRKLEKIRQDDT<br>SSSINFLTRVSGIGPSAARKFVDEGIKTLEDLRKNEDKLNHHQRIGL<br>KSGGSPKKKRKV |
| 44 | Amino acid sequence of ACX, rPB(8 kD) (Apobec is in bold; nCas9 is in parentheses [ ]; rPB(8 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ |

-continued

| SEQ ID NO: | Name | Sequence |
|---|---|---|
| | | KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKRKAPQETLNGGITDMLVELANFEKNVSQAIHKYNAYRKAASVI<br>AKYPHKIKSGAEAKKLPGVGTKIAEKIDEFLATGKLRKLEKSGGSP<br>KKKRKV |
| 45 | Amino acid sequence of ACX, rPB(14 kD) (Apobec is in bold; nCas9 is in parentheses [ ]; rPB(14 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKRKAPQETLNGGITDMLVELANFEKNVSQAIHKYNAYRKAASVI<br>AKYPHKIKSGAEAKKLPGVGTKIAEKIDEFLATGKLRKLEKIRQDDT<br>SSSINFLTRVTGIGPSAARKLVDEGIKTLEDLRKNEDKLNHHQRIGL<br>KSGGSPKKKRKV |
| 46 | Amino acid sequence of ACX, hPB(8 kD), wtCas9 (Apobec is in bold; wtCas9 is in parentheses [ ]; hPB(8 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLDIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR |

-continued

| SEQ ID NO: | Name | Sequence |
|---|---|---|
| | | FNASLGTYHDLLKIIKDKDFLDNEENEDILEDIVLTLTLFEDREMIEE |
| | | RLKTYAHLFDDKVMKQLKRRRYTGWGRLSRKLINGIRDKQSGKTI |
| | | LDFLKSDGFANRNFMQLIHDDSLTFKEDIQKAQVSGQGDSLHEHIA |
| | | NLAGSPAIKKGILQTVKVVDELVKVMGRHKPENIVIEMARENQTTQ |
| | | KGQKNSRERMKRIEEGIKELGSQILKEHPVENTQLQNEKLYLYYLQ |
| | | NGRDMYVDQELDINRLSDYDVDHIVPQSFLKDDSIDNKVLTRSDK |
| | | NRGKSDNVPSEEVVKKMKNYWRQLLNAKLITQRKFDNLTKAERG |
| | | GLSELDKAGFIKRQLVETRQITKHVAQILDSRMNTKYDENDKLIREV |
| | | KVITLKSKLVSDFRKDFQFYKVREINNYHHAHDAYLNAVVGTALIKK |
| | | YPKLESEFVYGDYKVYDVRKMIAKSEQEIGKATAKYFFYSNIMNFF |
| | | KTEITLANGEIRKRPLIETNGETGEIVWDKGRDFATVRKVLSMPQV |
| | | NIVKKTEVQTGGFSKESILPKRNSDKLIARKKDWDPKKYGGFDSPT |
| | | VAYSVLVVAKVEKGKSKKLKSVKELLGITIMERSSFEKNPIDFLEAK |
| | | GYKEVKKDLIIKLPKYSLFELENGRKRMLASAGELQKGNELALPSK |
| | | YVNFLYLASHYEKLKGSPEDNEQKQLFVEQHKHYLDEIIEQISEFS |
| | | KRVILADANLDKVLSAYNKHRDKPIREQAENIIHLFTLTNLGAPAAF |
| | | KYFDTTIDRKRYTSTKEVLDATLIHQSITGLYETRIDLSQLGGD]SGG |
| | | SSKRKAPQETLNGGITDMLTELANFEKNVSQAIHKYNAYRKAASVI |
| | | AKYPHKIKSGAEAKKLPGVGTKIAEKIDEFLATGKLRKLEKSGGSP |
| | | KKKRKV |
| 47 | Amino acid | **MSSETGPVAVDPTLRRRIEPHEFEVFFDPRELRKETCLLYEINWG** |
| | sequence of | **GRHSIWRHTSQNTNKHVEVNFIEKFTTERYFCPNTRCSITWFLSW** |
| | ACX, | **SPCGECSRAITEFLSRYPHVTLFIYIARLYHHADPRNRQGLRDLIS** |
| | hPB(14 kD), | **SGVTIQIMTEQESGYCWRNFVNYSPSNEAHWPRYPHLWVRLYVL** |
| | wtCas9 | **ELYCIILGLPPCLNILRRKQPQLTFFTIALQSCHYQRLPPHILWATG** |
| | (Apobec is | **LK**SGSETPGTSESATPES[DKKYSIGLDIGTNSVGWAVITDEYKVP |
| | in bold; | SKKFKVLGNTDRHSIKKNLIGALLFDSGETAEATRLKRTARRRYTR |
| | wtCas9 is in | RKNRICYLQEIFSNEMAKVDDSFFHRLEESFLVEEDKKHERHPIFG |
| | parentheses | NIVDEVAYHEKYPTIYHLRKKLVDSTDKADLRLIYLALAHMIKFRGH |
| | [ ]; | FLIEGDLNPDNSDVDKLFIQLVQTYNQLFEENPINASGVDAKAILSA |
| | hPB(14 kD) | RLSKSRRLENLIAQLPGEKKNGLFGNLIALSLGLTPNFKSNFDLAED |
| | is | AKLQLSKDTYDDDLDNLLAQIGDQYADLFLAAKNLSDAILLSDILRV |
| | underlined) | NTEITKAPLSASMIKRYDEHHQDLTLLKALVRQQLPEKYKEIFFDQS |
| | | KNGYAGYIDGGASQEEFYKFIKPILEKMDGTEELLVKLNREDLLRK |
| | | QRTFDNGSIPHQIHLGELHAILRRQEDFYPFLKDNREKIEKILTFRIP |
| | | YYVGPLARGNSRFAWMTRKSEETITPWNFEEVVDKGASAQSFIER |
| | | MTNFDKNLPNEKVLPKHSLLYEYFTVYNELTKVKYVTEGMRKPAF |
| | | LSGEQKKAIVDLLFKTNRKVTVKQLKEDYFKKIECFDSVEISGVEDR |
| | | FNASLGTYHDLLKIIKDKDFLDNEENEDILEDIVLTLTLFEDREMIEE |
| | | RLKTYAHLFDDKVMKQLKRRRYTGWGRLSRKLINGIRDKQSGKTI |
| | | LDFLKSDGFANRNFMQLIHDDSLTFKEDIQKAQVSGQGDSLHEHIA |
| | | NLAGSPAIKKGILQTVKVVDELVKVMGRHKPENIVIEMARENQTTQ |
| | | KGQKNSRERMKRIEEGIKELGSQILKEHPVENTQLQNEKLYLYYLQ |
| | | NGRDMYVDQELDINRLSDYDVDHIVPQSFLKDDSIDNKVLTRSDK |
| | | NRGKSDNVPSEEVVKKMKNYWRQLLNAKLITQRKFDNLTKAERG |
| | | GLSELDKAGFIKRQLVETRQITKHVAQILDSRMNTKYDENDKLIREV |
| | | KVITLKSKLVSDFRKDFQFYKVREINNYHHAHDAYLNAVVGTALIKK |
| | | YPKLESEFVYGDYKVYDVRKMIAKSEQEIGKATAKYFFYSNIMNFF |
| | | KTEITLANGEIRKRPLIETNGETGEIVWDKGRDFATVRKVLSMPQV |
| | | NIVKKTEVQTGGFSKESILPKRNSDKLIARKKDWDPKKYGGFDSPT |
| | | VAYSVLVVAKVEKGKSKKLKSVKELLGITIMERSSFEKNPIDFLEAK |
| | | GYKEVKKDLIIKLPKYSLFELENGRKRMLASAGELQKGNELALPSK |
| | | YVNFLYLASHYEKLKGSPEDNEQKQLFVEQHKHYLDEIIEQISEFS |
| | | KRVILADANLDKVLSAYNKHRDKPIREQAENIIHLFTLTNLGAPAAF |
| | | KYFDTTIDRKRYTSTKEVLDATLIHQSITGLYETRIDLSQLGGD]SGG |
| | | SSKRKAPQETLNGGITDMLTELANFEKNVSQAIHKYNAYRKAASVI |
| | | AKYPHKIKSGAEAKKLPGVGTKIAEKIDEFLATGKLRKLEKIRQDDT |
| | | SSSINFLTRVSGIGPSAARKFVDEGIKTLEDLRKNEDKLNHHQRIGL |
| | | KSGGSPKKKRKV |
| 48 | Amino acid | **MSSETGPVAVDPTLRRRIEPHEFEVFFDPRELRKETCLLYEINWG** |
| | sequence of | **GRHSIWRHTSQNTNKHVEVNFIEKFTTERYFCPNTRCSITWFLSW** |
| | ACX, | **SPCGECSRAITEFLSRYPHVTLFIYIARLYHHADPRNRQGLRDLIS** |
| | rPB(8 kD), | **SGVTIQIMTEQESGYCWRNFVNYSPSNEAHWPRYPHLWVRLYVL** |
| | wtCas9 | **ELYCIILGLPPCLNILRRKQPQLTFFTIALQSCHYQRLPPHILWATG** |
| | (Apobec is | **LK**SGSETPGTSESATPES[DKKYSIGLDIGTNSVGWAVITDEYKVP |
| | in bold; | SKKFKVLGNTDRHSIKKNLIGALLFDSGETAEATRLKRTARRRYTR |
| | wtCas9 is in | RKNRICYLQEIFSNEMAKVDDSFFHRLEESFLVEEDKKHERHPIFG |
| | parentheses | NIVDEVAYHEKYPTIYHLRKKLVDSTDKADLRLIYLALAHMIKFRGH |
| | [ ]; | FLIEGDLNPDNSDVDKLFIQLVQTYNQLFEENPINASGVDAKAILSA |
| | rPB(8 kD) is | RLSKSRRLENLIAQLPGEKKNGLFGNLIALSLGLTPNFKSNFDLAED |
| | underlined) | AKLQLSKDTYDDDLDNLLAQIGDQYADLFLAAKNLSDAILLSDILRV |
| | | NTEITKAPLSASMIKRYDEHHQDLTLLKALVRQQLPEKYKEIFFDQS |
| | | KNGYAGYIDGGASQEEFYKFIKPILEKMDGTEELLVKLNREDLLRK |

-continued

| SEQ ID NO: | Name | Sequence |
|---|---|---|
| | | QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKRKAPQETLNGGITDMLVELANFEKNVSQAIHKYNAYRKAASVI<br>AKYPHKIKSGAEAKKLPGVGTKIAEKIDEFLATGKLRKLEKSGGSP<br>KKKRKV |
| 49 | Amino acid sequence of ACX, rPB(14 kD), wtCas9 (Apobec is in bold; wtCas9 is in parentheses [ ]; rPB(14 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLDIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKRKAPQETLNGGITDMLVELANFEKNVSQAIHKYNAYRKAASVI<br>AKYPHKIKSGAEAKKLPGVGTKIAEKIDEFLATGKLRKLEKIRQDDT<br>SSSINFLTRVTGIGPSAARKLVDEGIKTLEDLRKNEDKLNHHQRIGL<br>KSGGSPKKKRKV |
| 50 | Amino acid sequence of AXC, hPB(8 kD) (Apobec is in bold; nCas9 is in | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSSKRKAPQETLNGGITDMLTELANFEKNVSQAIHKYNAYR<br>KAASVIAKYPHKIKSGAEAKKLPGVGTKIAEKIDEFLATGKLRKLEK |

-continued

| SEQ ID NO: | Name | Sequence |
|---|---|---|
| | parentheses<br>[ ];<br>hPB(8 kD) is<br>underlined) | SGSETPGTSESATPES[DKKYSIGLAIGTNSVGWAVITDEYKVPSK<br>KFKVLGNTDRHSIKKNLIGALLFDSGETAEATRLKRTARRYTRRK<br>NRICYLQEIFSNEMAKVDDSFFHRLEESFLVEEDKKHERHPIFGNIV<br>DEVAYHEKYPTIYHLRKKLVDSTDKADLRLIYLALAHMIKFRGHFLIE<br>GDLNPDNSDVDKLFIQLVQTYNQLFEENPINASGVDAKAILSARLS<br>KSRRLENLIAQLPGEKKNGLFGNLIALSLGLTPNFKSNFDLAEDAKL<br>QLSKDTYDDDLDNLLAQIGDQYADLFLAAKNLSDAILLSDILRVNTEI<br>TKAPLSASMIKRYDEHHQDLTLLKALVRQQLPEKYKEIFFDQSKNG<br>YAGYIDGGASQEEFYKFIKPILEKMDGTEELLVKLNREDLLRKQRT<br>FDNGSIPHQIHLGELHAILRRQEDFYPFLKDNREKIEKILTFRIPYYV<br>GPLARGNSRFAWMTRKSEETITPWNFEEVVDKGASAQSFIERMT<br>NFDKNLPNEKVLPKHSLLYEYFTVYNELTKVKYVTEGMRKPAFLS<br>GEQKKAIVDLLFKTNRKVTVKQLKEDYFKKIECFDSVEISGVEDRF<br>NASLGTYHDLLKIIKDKDFLDNEENEDILEDIVLTLTLFEDREMIEER<br>LKTYAHLFDDKVMKQLKRRRYTGWGRLSRKLINGIRDKQSGKTIL<br>DFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SPKKKRKV |
| 51 | Amino acid<br>sequence of<br>AXC,<br>hPB(14 kD)<br>(Apobec is<br>in bold;<br>nCas9 is in<br>parentheses<br>[ ];<br>hPB(14 kD)<br>is<br>underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSSKRKAPQETLNGGITDMLTELANFEKNVSQAIHKYNAYR<br>KAASVIAKYPHKIKSGAEAKKLPGVGTKIAEKIDEFLATGKLRKLEKI<br>RQDDTSSSINFLTRVSGIGPSAARKFVDEGIKTLEDLRKNEDKLNH<br>HQRIGLKSGSETPGTSESATPESfDKKYSIGLAIGTNSVGWAVITDE<br>YKVPSKKFKVLGNTDRHSIKKNLIGALLFDSGETAEATRLKRTARR<br>RYTRRKNRICYLQEIFSNEMAKVDDSFFHRLEESFLVEEDKKHER<br>HPIFGNIVDEVAYHEKYPTIYHLRKKLVDSTDKADLRLIYLALAHMIK<br>FRGHFLIEGDLNPDNSDVDKLFIQLVQTYNQLFEENPINASGVDAK<br>AILSARLSKSRRLENLIAQLPGEKKNGLFGNLIALSLGLTPNFKSNF<br>DLAEDAKLQLSKDTYDDDLDNLLAQIGDQYADLFLAAKNLSDAILLS<br>DILRVNTEITKAPLSASMIKRYDEHHQDLTLLKALVRQQLPEKYKEI<br>FFDQSKNGYAGYIDGGASQEEFYKFIKPILEKMDGTEELLVKLNRE<br>DLLRKQRTFDNGSIPHQIHLGELHAILRRQEDFYPFLKDNREKIEKI<br>LTFRIPYYVGPLARGNSRFAWMTRKSEETITPWNFEEVVDKGASA<br>QSFIERMTNFDKNLPNEKVLPKHSLLYEYFTVYNELTKVKYVTEGM<br>RKPAFLSGEQKKAIVDLLFKTNRKVTVKQLKEDYFKKIECFDSVEIS<br>GVEDRFNASLGTYHDLLKIIKDKDFLDNEENEDILEDIVLTLTLFEDR<br>EMIEERLKTYAHLFDDKVMKQLKRRRYTGWGRLSRKLINGIRDKQ<br>SGKTILDFLKSDGFANRNFMQLIHDDSLTFKEDIQKAQVSGQGDSL<br>HEHIANLAGSPAIKKGILQTVKVVDELVKVMGRHKPENIVIEMAREN<br>QTTQKGQKNSRERMKRIEEGIKELGSQILKEHPVENTQLQNEKLYL<br>YYLQNGRDMYVDQELDINRLSDYDVDHIVPQSFLKDDSIDNKVLTR<br>SDKNRGKSDNVPSEEVVKKMKNYWRQLLNAKLITQRKFDNLTKA<br>ERGGLSELDKAGFIKRQLVETRQITKHVAQILDSRMNTKYDENDKL<br>IREVKVITLKSKLVSDFRKDFQFYKVREINNYHHAHDAYLNAVVGT<br>ALIKKYPKLESEFVYGDYKVYDVRKMIAKSEQEIGKATAKYFFYSNI<br>MNFFKTEITLANGEIRKRPLIETNGETGEIVWDKGRDFATVRKVLS<br>MPQVNIVKKTEVQTGGFSKESILPKRNSDKLIARKKDWDPKKYGG<br>FDSPTVAYSVLVVAKVEKGKSKKLKSVKELLGITIMERSSFEKNPID<br>FLEAKGYKEVKKDLIIKLPKYSLFELENGRKRMLASAGELQKGNEL<br>ALPSKYVNFLYLASHYEKLKGSPEDNEQKQLFVEQHKHYLDEIIEQI<br>SEFSKRVILADANLDKVLSAYNKHRDKPIREQAENIIHLFTLTNLGA<br>PAAFKYFDTTIDRKRYTSTKEVLDATLIHQSITGLYETRIDLSQLGG<br>D]SGGSPKKKRKV |

-continued

| SEQ ID NO: | Name | Sequence |
|---|---|---|
| 52 | Amino acid sequence of AXC, rPB(8 kD) (Apobec is in bold; nCas9 is in parentheses [ ]; rPB(8 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSSKRKAPQETLNGGITDMLVELANFEKNVSQAIHKYNAYR<br>KAASVIAKYPHKIKSGAEAKKLPGVGTKIAEKIDEFLATGKLRKLEK<br>SGSETPGTSESATPES[DKKYSIGLAIGTNSVGWAVITDEYKVPSK<br>KFKVLGNTDRHSIKKNLIGALLFDSGETAEATRLKRTARRRYTRRK<br>NRICYLQEIFSNEMAKVDDSFFHRLEESFLVEEDKKHERHPIFGNIV<br>DEVAYHEKYPTIYHLRKKLVDSTDKADLRLIYLALAHMIKFRGHFLIE<br>GDLNPDNSDVDKLFIQLVQTYNQLFEENPINASGVDAKAILSARLS<br>KSRRLENLIAQLPGEKKNGLFGNLIALSLGLTPNFKSNFDLAEDAKL<br>QLSKDTYDDDLDNLLAQIGDQYADLFLAAKNLSDAILLSDILRVNTEI<br>TKAPLSASMIKRYDEHHQDLTLLKALVRQQLPEKYKEIFFDQSKNG<br>YAGYIDGGASQEEFYKFIKPILEKMDGTEELLVKLNREDLLRKQRT<br>FDNGSIPHQIHLGELHAILRRQEDFYPFLKDNREKIEKILTFRIPYYV<br>GPLARGNSRFAWMTRKSEETITPWNFEEVVDKGASAQSFIERMT<br>NFDKNLPNEKVLPKHSLLYEYFTVYNELTKVKYVTEGMRKPAFLS<br>GEQKKAIVDLLFKTNRKVTVKQLKEDYFKKIECFDSVEISGVEDRF<br>NASLGTYHDLLKIIKDKDFLDNEENEDILEDIVLTLTLFEDREMIEER<br>LKTYAHLFDDKVMKQLKRRRYTGWGRLSRKLINGIRDKQSGKTIL<br>DFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SPKKKRKV |
| 53 | Amino acid sequence of AXC, rPB(14 kD) (Apobec is in bold; nCas9 is in parentheses [ ]; rPB(14 kD) is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSSKRKAPQETLNGGITDMLVELANFEKNVSQAIHKYNAYR<br>KAASVIAKYPHKIKSGAEAKKLPGVGTKIAEKIDEFLATGKLRKLEKI<br>RQDDTSSSINFLTRVTGIGPSAARKLVDEGIKTLEDLRKNEDKLNH<br>HQRIGLKSGSETPGTSESATPESfDKKYSIGLAIGTNSVGWAVITDE<br>YKVPSKKFKVLGNTDRHSIKKNLIGALLFDSGETAEATRLKRTARR<br>RYTRRKNRICYLQEIFSNEMAKVDDSFFHRLEESFLVEEDKKHER<br>HPIFGNIVDEVAYHEKYPTIYHLRKKLVDSTDKADLRLIYLALAHMIK<br>FRGHFLIEGDLNPDNSDVDKLFIQLVQTYNQLFEENPINASGVDAK<br>AILSARLSKSRRLENLIAQLPGEKKNGLFGNLIALSLGLTPNFKSNF<br>DLAEDAKLQLSKDTYDDDLDNLLAQIGDQYADLFLAAKNLSDAILLS<br>DILRVNTEITKAPLSASMIKRYDEHHQDLTLLKALVRQQLPEKYKEI<br>FFDQSKNGYAGYIDGGASQEEFYKFIKPILEKMDGTEELLVKLNRE<br>DLLRKQRTFDNGSIPHQIHLGELHAILRRQEDFYPFLKDNREKIEKI<br>LTFRIPYYVGPLARGNSRFAWMTRKSEETITPWNFEEVVDKGASA<br>QSFIERMTNFDKNLPNEKVLPKHSLLYEYFTVYNELTKVKYVTEGM<br>RKPAFLSGEQKKAIVDLLFKTNRKVTVKQLKEDYFKKIECFDSVEIS<br>GVEDRFNASLGTYHDLLKIIKDKDFLDNEENEDILEDIVLTLTLFEDR<br>EMIEERLKTYAHLFDDKVMKQLKRRRYTGWGRLSRKLINGIRDKQ<br>SGKTILDFLKSDGFANRNFMQLIHDDSLTFKEDIQKAQVSGQGDSL<br>HEHIANLAGSPAIKKGILQTVKVVDELVKVMGRHKPENIVIEMAREN<br>QTTQKGQKNSRERMKRIEEGIKELGSQILKEHPVENTQLQNEKLYL<br>YYLQNGRDMYVDQELDINRLSDYDVDHIVPQSFLKDDSIDNKVLTR<br>SDKNRGKSDNVPSEEVVKKMKNYWRQLLNAKLITQRKFDNLTKA<br>ERGGLSELDKAGFIKRQLVETRQITKHVAQILDSRMNTKYDENDKL<br>IREVKVITLKSKLVSDFRKDFQFYKVREINNYHHAHDAYLNAVVGT<br>ALIKKYPKLESEFVYGDYKVYDVRKMIAKSEQEIGKATAKYFFYSNI<br>MNFFKTEITLANGEIRKRPLIETNGETGEIVWDKGRDFATVRKVLS<br>MPQVNIVKKTEVQTGGFSKESILPKRNSDKLIARKKDWDPKKYGG<br>FDSPTVAYSVLVVAKVEKGKSKKLKSVKELLGITIMERSSFEKNPID<br>FLEAKGYKEVKKDLIIKLPKYSLFELENGRKRMLASAGELQKGNEL |

-continued

| SEQ ID NO: | Name | Sequence |
|---|---|---|
| | | ALPSKYVNFLYLASHYEKLKGSPEDNEQKQLFVEQHKHYLDEIIEQI<br>SEFSKRVILADANLDKVLSAYNKHRDKPIREQAENIIHLFTLTNLGA<br>PAAFKYFDTTIDRKRYTSTKEVLDATLIHQSITGLYETRIDLSQLGG<br>D]SGGSPKKKRKV |
| 54 | Amino acid sequence of XAC, hPB(8 kD) (Apobec is in bold; nCas9 is in parentheses [ ]; hPB(8 kD) is underlined) | MSKRKAPQETLNGGITDMLTELANFEKNVSQAIHKYNAYRKAASVI<br>AKYPHKIKSGAEAKKLPGVGTKIAEKIDEFLATGKLRKLEKSGGS**S**<br>**SETGPVAVDPTLRRRIEPHEFEVFFDPRELRKETCLLYEINWGGR**<br>**HSIWRHTSQNTNKHVEVNFIEKFTTERYFCPNTRCSITWFLSWSP**<br>**CGECSRAITEFLSRYPHVTLFIYIARLYHHADPRNRQGLRDLISSG**<br>**VTIQIMTEQESGYCWRNFVNYSPSNEAHWPRYPHLWVRLYVLEL**<br>**YCIILGLPPCLNILRRKQPQLTFFTIALQSCHYQRLPPHILWATGLK**<br>SGSETPGTSESATPES[DKKYSIGLAIGTNSVGWAVITDEYKVPSK<br>KFKVLGNTDRHSIKKNLIGALLFDSGETAEATRLKRTARRRYTRRK<br>NRICYLQEIFSNEMAKVDDSFFHRLEESFLVEEDKKHERHPIFGNIV<br>DEVAYHEKYPTIYHLRKKLVDSTDKADLRLIYLALAHMIKFRGHFLIE<br>GDLNPDNSDVDKLFIQLVQTYNQLFEENPINASGVDAKAILSARLS<br>KSRRLENLIAQLPGEKKNGLFGNLIALSLGLTPNFKSNFDLAEDAKL<br>QLSKDTYDDDLDNLLAQIGDQYADLFLAAKNLSDAILLSDILRVNTEI<br>TKAPLSASMIKRYDEHHQDLTLLKALVRQQLPEKYKEIFFDQSKNG<br>YAGYIDGGASQEEFYKFIKPILEKMDGTEELLVKLNREDLLRKQRT<br>FDNGSIPHQIHLGELHAILRRQEDFYPFLKDNREKIEKILTFRIPYYV<br>GPLARGNSRFAWMTRKSEETITPWNFEEVVDKGASAQSFIERMT<br>NFDKNLPNEKVLPKHSLLYEYFTVYNELTKVKYVTEGMRKPAFLS<br>GEQKKAIVDLLFKTNRKVTVKQLKEDYFKKIECFDSVEISGVEDRF<br>NASLGTYHDLLKIIKDKDFLDNEENEDILEDIVLTLTLFEDREMIEER<br>LKTYAHLFDDKVMKQLKRRRYTGWGRLSRKLINGIRDKQSGKTIL<br>DFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SPKKKRKV |
| 55 | Amino acid sequence of XAC, hPB(14 kD) (Apobec is in bold; nCas9 is in parentheses [ ]; hPB(14 kD) is underlined) | MSKRKAPQETLNGGITDMLTELANFEKNVSQAIHKYNAYRKAASVI<br>AKYPHKIKSGAEAKKLPGVGTKIAEKIDEFLATGKLRKLEKIRQDDT<br>SSSINFLTRVSGIGPSAARKFVDEGIKTLEDLRKNEDKLNHHQRIGL<br>KSGGS**SSETGPVAVDPTLRRRIEPHEFEVFFDPRELRKETCLLYEI**<br>**NWGGRHSIWRHTSQNTNKHVEVNFIEKFTTERYFCPNTRCSITWF**<br>**LSWSPCGECSRAITEFLSRYPHVTLFIYIARLYHHADPRNRQGLR**<br>**DLISSGVTIQIMTEQESGYCWRNFVNYSPSNEAHWPRYPHLWVR**<br>**LYVLELYCIILGLPPCLNILRRKQPQLTFFTIALQSCHYQRLPPHIL**<br>**WATGLK**SGSETPGTSESATPES[DKKYSIGLAIGTNSVGWAVITDE<br>YKVPSKKFKVLGNTDRHSIKKNLIGALLFDSGETAEATRLKRTARR<br>RYTRRKNRICYLQEIFSNEMAKVDDSFFHRLEESFLVEEDKKHER<br>HPIFGNIVDEVAYHEKYPTIYHLRKKLVDSTDKADLRLIYLALAHMIK<br>FRGHFLIEGDLNPDNSDVDKLFIQLVQTYNQLFEENPINASGVDAK<br>AILSARLSKSRRLENLIAQLPGEKKNGLFGNLIALSLGLTPNFKSNF<br>DLAEDAKLQLSKDTYDDDLDNLLAQIGDQYADLFLAAKNLSDAILLS<br>DILRVNTEITKAPLSASMIKRYDEHHQDLTLLKALVRQQLPEKYKEI<br>FFDQSKNGYAGYIDGGASQEEFYKFIKPILEKMDGTEELLVKLNRE<br>DLLRKQRTFDNGSIPHQIHLGELHAILRRQEDFYPFLKDNREKIEKI<br>LTFRIPYYVGPLARGNSRFAWMTRKSEETITPWNFEEVVDKGASA<br>QSFIERMTNFDKNLPNEKVLPKHSLLYEYFTVYNELTKVKYVTEGM<br>RKPAFLSGEQKKAIVDLLFKTNRKVTVKQLKEDYFKKIECFDSVEIS<br>GVEDRFNASLGTYHDLLKIIKDKDFLDNEENEDILEDIVLTLTLFEDR<br>EMIEERLKTYAHLFDDKVMKQLKRRRYTGWGRLSRKLINGIRDKQ<br>SGKTILDFLKSDGFANRNFMQLIHDDSLTFKEDIQKAQVSGQGDSL<br>HEHIANLAGSPAIKKGILQTVKVVDELVKVMGRHKPENIVIEMAREN<br>QTTQKGQKNSRERMKRIEEGIKELGSQILKEHPVENTQLQNEKLYL<br>YYLQNGRDMYVDQELDINRLSDYDVDHIVPQSFLKDDSIDNKVLTR<br>SDKNRGKSDNVPSEEVVKKMKNYWRQLLNAKLITQRKFDNLTKA<br>ERGGLSELDKAGFIKRQLVETRQITKHVAQILDSRMNTKYDENDKL<br>IREVKVITLKSKLVSDFRKDFQFYKVREINNYHHAHDAYLNAVVGT<br>ALIKKYPKLESEFVYGDYKVYDVRKMIAKSEQEIGKATAKYFFYSNI |

-continued

| SEQ ID NO: | Name | Sequence |
|---|---|---|
| | | MNFFKTEITLANGEIRKRPLIETNGETGEIVWDKGRDFATVRKVLS<br>MPQVNIVKKTEVQTGGFSKESILPKRNSDKLIARKKDWDPKKYGG<br>FDSPTVAYSVLVVAKVEKGKSKKLKSVKELLGITIMERSSFEKNPID<br>FLEAKGYKEVKKDLIIKLPKYSLFELENGRKRMLASAGELQKGNEL<br>ALPSKYVNFLYLASHYEKLKGSPEDNEQKQLFVEQHKHYLDEIIEQI<br>SEFSKRVILADANLDKVLSAYNKHRDKPIREQAENIIHLFTLTNLGA<br>PAAFKYFDTTIDRKRYTSTKEVLDATLIHQSITGLYETRIDLSQLGG<br>D]SGGSPKKKRKV |
| 56 | Amino acid sequence of XAC, rPB(8 kD) (Apobec is in bold; nCas9 is in parentheses [ ]; rPB(8kD) is underlined) | MSKRKAPQETLNGGITDMLVELANFEKNVSQAIHKYNAYRKAASVI<br>AKYPHKIKSGAEAKKLPGVGTKIAEKIDEFLATGKLRKLEKSGGS**S**<br>**SETGPVAVDPTLRRRIEPHEFEVFFDPRELRKETCLLYEINWGGR**<br>**HSIWRHTSQNTNKHVEVNFIEKFTTERYFCPNTRCSITWFLSWSP**<br>**CGECSRAITEFLSRYPHVTLFIYIARLYHHADPRNRQGLRDLISSG**<br>**VTIQIMTEQESGYCWRNFVNYSPSNEAHWPRYPHLWVRLYVLEL**<br>**YCIILGLPPCLNILRRKQPQLTFFTIALQSCHYQRLPPHILWATGLK**<br>SGSETPGTSESATPES[DKKYSIGLAIGTNSVGWAVITDEYKVPSK<br>KFKVLGNTDRHSIKKNLIGALLFDSGETAEATRLKRTARRRYTRRK<br>NRICYLQEIFSNEMAKVDDSFFHRLEESFLVEEDKKHERHPIFGNIV<br>DEVAYHEKYPTIYHLRKKLVDSTDKADLRLIYLALAHMIKFRGHFLIE<br>GDLNPDNSDVDKLFIQLVQTYNQLFEENPINASGVDAKAILSARLS<br>KSRRLENLIAQLPGEKKNGLFGNLIALSLGLTPNFKSNFDLAEDAKL<br>QLSKDTYDDDLDNLLAQIGDQYADLFLAAKNLSDAILLSDILRVNTEI<br>TKAPLSASMIKRYDEHHQDLTLLKALVRQQLPEKYKEIFFDQSKNG<br>YAGYIDGGASQEEFYKFIKPILEKMDGTEELLVKLNREDLLRKQRT<br>FDNGSIPHQIHLGELHAILRRQEDFYPFLKDNREKIEKILTFRIPYYV<br>GPLARGNSRFAWMTRKSEETITPWNFEEVVDKGASAQSFIERMT<br>NFDKNLPNEKVLPKHSLLYEYFTVYNELTKVKYVTEGMRKPAFLS<br>GEQKKAIVDLLFKTNRKVTVKQLKEDYFKKIECFDSVEISGVEDRF<br>NASLGTYHDLLKIIKDKDFLDNEENEDILEDIVLTLTLFEDREMIEER<br>LKTYAHLFDDKVMKQLKRRRYTGWGRLSRKLINGIRDKQSGKTIL<br>DFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SPKKKRKV |
| 57 | Amino acid sequence of XAC, rPB(14 kD) (Apobec is in bold; nCas9 is in parentheses [ ]; rPB(14 kD) is underlined) | MSKRKAPQETLNGGITDMLVELANFEKNVSQAIHKYNAYRKAASVI<br>AKYPHKIKSGAEAKKLPGVGTKIAEKIDEFLATGKLRKLEKIRQDDT<br>SSSINFLTRVTGIGPSAARKLVDEGIKTLEDLRKNEDKLNHHQRIGL<br>KSGGS**SSETGPVAVDPTLRRRIEPHEFEVFFDPRELRKETCLLYEI**<br>**NWGGRHSIWRHTSQNTNKHVEVNFIEKFTTERYFCPNTRCSITWF**<br>**LSWSPCGECSRAITEFLSRYPHVTLFIYIARLYHHADPRNRQGLR**<br>**DLISSGVTIQIMTEQESGYCWRNFVNYSPSNEAHWPRYPHLWVR**<br>**LYVLELYCIILGLPPCLNILRRKQPQLTFFTIALQSCHYQRLPPHIL**<br>**WATGLK**SGSETPGTSESATPES[DKKYSIGLAIGTNSVGWAVITDE<br>YKVPSKKFKVLGNTDRHSIKKNLIGALLFDSGETAEATRLKRTARR<br>RYTRRKNRICYLQEIFSNEMAKVDDSFFHRLEESFLVEEDKKHER<br>HPIFGNIVDEVAYHEKYPTIYHLRKKLVDSTDKADLRLIYLALAHMIK<br>FRGHFLIEGDLNPDNSDVDKLFIQLVQTYNQLFEENPINASGVDAK<br>AILSARLSKSRRLENLIAQLPGEKKNGLFGNLIALSLGLTPNFKSNF<br>DLAEDAKLQLSKDTYDDDLDNLLAQIGDQYADLFLAAKNLSDAILLS<br>DILRVNTEITKAPLSASMIKRYDEHHQDLTLLKALVRQQLPEKYKEI<br>FFDQSKNGYAGYIDGGASQEEFYKFIKPILEKMDGTEELLVKLNRE<br>DLLRKQRTFDNGSIPHQIHLGELHAILRRQEDFYPFLKDNREKIEKI<br>LTFRIPYYVGPLARGNSRFAWMTRKSEETITPWNFEEVVDKGASA<br>QSFIERMTNFDKNLPNEKVLPKHSLLYEYFTVYNELTKVKYVTEGM<br>RKPAFLSGEQKKAIVDLLFKTNRKVTVKQLKEDYFKKIECFDSVEIS<br>GVEDRFNASLGTYHDLLKIIKDKDFLDNEENEDILEDIVLTLTLFEDR<br>EMIEERLKTYAHLFDDKVMKQLKRRRYTGWGRLSRKLINGIRDKQ<br>SGKTILDFLKSDGFANRNFMQLIHDDSLTFKEDIQKAQVSGQGDSL<br>HEHIANLAGSPAIKKGILQTVKVVDELVKVMGRHKPENIVIEMAREN<br>QTTQKGQKNSRERMKRIEEGIKELGSQILKEHPVENTQLQNEKLYL<br>YYLQNGRDMYVDQELDINRLSDYDVDHIVPQSFLKDDSIDNKVLTR |

-continued

| SEQ ID NO: | Name | Sequence |
|---|---|---|
| | | SDKNRGKSDNVPSEEVVKKMKNYWRQLLNAKLITQRKFDNLTKA<br>ERGGLSELDKAGFIKRQLVETRQITKHVAQILDSRMNTKYDENDKL<br>IREVKVITLKSKLVSDFRKDFQFYKVREINNYHHAHDAYLNAVVGT<br>ALIKKYPKLESEFVYGDYKVYDVRKMIAKSEQEIGKATAKYFFYSNI<br>MNFFKTEITLANGEIRKRPLIETNGETGEIVWDKGRDFATVRKVLS<br>MPQVNIVKKTEVQTGGFSKESILPKRNSDKLIARKKDWDPKKYGG<br>FDSPTVAYSVLVVAKVEKGKSKKLKSVKELLGITIMERSSFEKNPID<br>FLEAKGYKEVKKDLIIKLPKYSLFELENGRKRMLASAGELQKGNEL<br>ALPSKYVNFLYLASHYEKLKGSPEDNEQKQLFVEQHKHYLDEIIEQI<br>SEFSKRVILADANLDKVLSAYNKHRDKPIREQAENIIHLFTLTNLGA<br>PAAFKYFDTTIDRKRYTSTKEVLDATLIHQSITGLYETRIDLSQLGG<br>D]SGGSPKKKRKV |
| 58 | Amino acid sequence of ACX, hXRCC1 (Apobec is in bold; nCas9 is in parentheses [ ]; hXRCC1 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SGPEIRLRHVVSCSSQDSTHCAENLLKADTYRKWRAAKAGEKTIS<br>VVLQLEKEEQIHSVDIGNDGSAFVEVLVGSSAGGAGEQDYEVLLV<br>TSSFMSPSESRSGSNPNRVRMFGPDKLVRAAAEKRWDRVKIVCS<br>QPYSKDSPFGLSFVRFHSPPDKDEAEAPSQKVTVTKLGQFRVKEE<br>DESANSLRPGALFFSRINKTSPVTASDPAGPSYAAATLQASSAASS<br>ASPVSRAIGSTSKPQESPKGKRKLDLNQEEKKTPSKPPAQLSPSV<br>PKRPKLPAPTRTPATAPVPARAQGAVTGKPRGEGTEPRRPRAGP<br>EELGKILQGVVVVLSGFQNPFRSELRDKALELGAKYRPDWTRDST<br>HLICAFANTPKYSQVLGLGGRIVRKEWVLDCHRMRRRLPSQRYLM<br>AGPGSSSEEDEASHSGGSGDEAPKLPQKQPQTKTKPTQAAGPSS<br>PQKPPTPEETKAASPVLQEDIDIEGVQSEGQDNGAEDSGDTEDEL<br>RRVAEQKEHRLPPGQEENGEDPYAGSTDENTDSEEHQEPPDLPV<br>PELPDFFQGKHFFLYGEFPGDERRKLIRYVTAFNGELEDYMSDRV<br>QFVITAQEWDPSFEEALMDNPSLAFVRPRWIYSCNEKQKLLPHQL<br>YGVVPQASGGSPKKKRKV |
| 59 | Amino acid sequence of ACX, hXRCC1, wtCas9 (Apobec is in bold; wtCas9 is in parentheses [ ]; | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLDIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA |

-continued

| SEQ ID NO: | Name | Sequence |
|---|---|---|
| | hXRCC1 is underlined) | RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SGPEIRLRHVVSCSSQDSTHCAENLLKADTYRKWRAAKAGEKTIS<br>VVLQLEKEEQIHSVDIGNDGSAFVEVLVGSSAGGAGEQDYEVLLV<br>TSSFMSPSESRSGSNPNRVRMFGPDKLVRAAAEKRWDRVKIVCS<br>QPYSKDSPFGLSFVRFHSPPDKDEAEAPSQKVTVTKLGQFRVKEE<br>DESANSLRPGALFFSRINKTSPVTASDPAGPSYAAATLQASSAASS<br>ASPVSRAIGSTSKPQESPKGKRKLDLNQEEKKTPSKPPAQLSPSV<br>PKRPKLPAPTRTPATAPVPARAQGAVTGKPRGEGTEPRRPRAGP<br>EELGKILQGVVVVLSGFQNPFRSELRDKALELGAKYRPDWTRDST<br>HLICAFANTPKYSQVLGLGGRIVRKEWVLDCHRMRRRLPSQRYLM<br>AGPGSSSEEDEASHSGGSGDEAPKLPQKQPQTKTKPTQAAGPSS<br>PQKPPTPEETKAASPVLQEDIDIEGVQSEGQDNGAEDSGDTEDEL<br>RRVAEQKEHRLPPGQEENGEDPYAGSTDENTDSEEHQEPPDLPV<br>PELPDFFQGKHFFLYGEFPGDERRKLIRYVTAFNGELEDYMSDRV<br>QFVITAQEWDPSFEEALMDNPSLAFVRPRWIYSCNEKQKLLPHQL<br>YGVVPQASGGSPKKKRKV |
| 60 | Amino acid sequence of AXC, hXRCC1 (Apobec is in bold; nCas9 is in parentheses [ ]; hXRCC1 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSGPEIRLRHVVSCSSQDSTHCAENLLKADTYRKWRAAKA<br>GEKTISVVLQLEKEEQIHSVDIGNDGSAFVEVLVGSSAGGAGEQD<br>YEVLLVTSSFMSPSESRSGSNPNRVRMFGPDKLVRAAAEKRWDR<br>VKIVCSQPYSKDSPFGLSFVRFHSPPDKDEAEAPSQKVTVTKLGQ<br>FRVKEEDESANSLRPGALFFSRINKTSPVTASDPAGPSYAAATLQA<br>SSAASSASPVSRAIGSTSKPQESPKGKRKLDLNQEEKKTPSKPPA<br>QLSPSVPKRPKLPAPTRTPATAPVPARAQGAVTGKPRGEGTEPR<br>RPRAGPEELGKILQGVVVVLSGFQNPFRSELRDKALELGAKYRPD<br>WTRDSTHLICAFANTPKYSQVLGLGGRIVRKEWVLDCHRMRRRL<br>PSQRYLMAGPGSSSEEDEASHSGGSGDEAPKLPQKQPQTKTKPT<br>QAAGPSSPQKPPTPEETKAASPVLQEDIDIEGVQSEGQDNGAEDS<br>GDTEDELRRVAEQKEHRLPPGQEENGEDPYAGSTDENTDSEEH<br>QEPPDLPVPELPDFFQGKHFFLYGEFPGDERRKLIRYVTAFNGEL<br>EDYMSDRVQFVITAQEWDPSFEEALMDNPSLAFVRPRWIYSCNE<br>KQKLLPHQLYGVVPQASGSETPGTSESATPESfDKKYSIGLAIGTN<br>SVGWAVITDEYKVPSKKFKVLGNTDRHSIKKNLIGALLFDSGETAE<br>ATRLKRTARRRYTRRKNRICYLQEIFSNEMAKVDDSFFHRLEESFL<br>VEEDKKHERHPIFGNIVDEVAYHEKYPTIYHLRKKLVDSTDKADLR<br>LIYLALAHMIKFRGHFLIEGDLNPDNSDVDKLFIQLVQTYNQLFEEN<br>PINASGVDAKAILSARLSKSRRLENLIAQLPGEKKNGLFGNLIALSL<br>GLTPNFKSNFDLAEDAKLQLSKDTYDDDLDNLLAQIGDQYADLFLA<br>AKNLSDAILLSDILRVNTEITKAPLSASMIKRYDEHHQDLTLLKALVR<br>QQLPEKYKEIFFDQSKNGYAGYIDGGASQEEFYKFIKPILEKMDGT<br>EELLVKLNREDLLRKQRTFDNGSIPHQIHLGELHAILRRQEDFYPFL<br>KDNREKIEKILTFRIPYYVGPLARGNSRFAWMTRKSEETITPWNFE<br>EVVDKGASAQSFIERMTNFDKNLPNEKVLPKHSLLYEYFTVYNELT<br>KVKYVTEGMRKPAFLSGEQKKAIVDLLFKTNRKVTVKQLKEDYFK<br>KIECFDSVEISGVEDRFNASLGTYHDLLKIIKDKDFLDNEENEDILED<br>IVLTLTLFEDREMIEERLKTYAHLFDDKVMKQLKRRRYTGWGRLSR |

-continued

| SEQ ID NO: | Name | Sequence |
|---|---|---|
| | | KLINGIRDKQSGKTILDFLKSDGFANRNFMQLIHDDSLTFKEDIQKA<br>QVSGQGDSLHEHIANLAGSPAIKKGILQTVKVVDELVKVMGRHKP<br>ENIVIEMARENQTTQKGQKNSRERMKRIEEGIKELGSQILKEHPVE<br>NTQLQNEKLYLYYLQNGRDMYVDQELDINRLSDYDVDHIVPQSFL<br>KDDSIDNKVLTRSDKNRGKSDNVPSEEVVKKMKNYWRQLLNAKLI<br>TQRKFDNLTKAERGGLSELDKAGFIKRQLVETRQITKHVAQILDSR<br>MNTKYDENDKLIREVKVITLKSKLVSDFRKDFQFYKVREINNYHHA<br>HDAYLNAVVGTALIKKYPKLESEFVYGDYKVYDVRKMIAKSEQEIG<br>KATAKYFFYSNIMNFFKTEITLANGEIRKRPLIETNGETGEIVWDKG<br>RDFATVRKVLSMPQVNIVKKTEVQTGGFSKESILPKRNSDKLIARK<br>KDWDPKKYGGFDSPTVAYSVLVVAKVEKGKSKKLKSVKELLGITIM<br>ERSSFEKNPIDFLEAKGYKEVKKDLIIKLPKYSLFELENGRKRMLAS<br>AGELQKGNELALPSKYVNFLYLASHYEKLKGSPEDNEQKQLFVEQ<br>HKHYLDEIIEQISEFSKRVILADANLDKVLSAYNKHRDKPIREQAENI<br>IHLFTLTNLGAPAAFKYFDTTIDRKRYTSTKEVLDATLIHQSITGLYE<br>TRIDLSQLGGD]SGGSPKKKRKV |
| 61 | Amino acid sequence of XAC, hXRCC1 (Apobec is in bold; nCas9 is in parentheses [ ]; hXRCC1 is underlined) | MGPEIRLRHVVSCSSQDSTHCAENLLKADTYRKWRAAKAGEKTIS<br>VVLQLEKEEQIHSVDIGNDGSAFVEVLVGSSAGGAGEQDYEVLLV<br>TSSFMSPSESRSGSNPNRVRMFGPDKLVRAAAEKRWDRVKIVCS<br>QPYSKDSPFGLSFVRFHSPPDKDEAEAPSQKVTVTKLGQFRVKEE<br>DESANSLRPGALFFSRINKTSPVTASDPAGPSYAAATLQASSAASS<br>ASPVSRAIGSTSKPQESPKGKRKLDLNQEEKKTPSKPPAQLSPSV<br>PKRPKLPAPTRTPATAPVPARAQGAVTGKPRGEGTEPRRPRAGP<br>EELGKILQGVVVVLSGFQNPFRSELRDKALELGAKYRPDWTRDST<br>HLICAFANTPKYSQVLGLGGRIVRKEWVLDCHRMRRRLPSQRYLM<br>AGPGSSSEEDEASHSGGSGDEAPKLPQKQPQTKTKPTQAAGPSS<br>PQKPPTPEETKAASPVLQEDIDIEGVQSEGQDNGAEDSGDTEDEL<br>RRVAEQKEHRLPPGQEENGEDPYAGSTDENTDSEEHQEPPDLPV<br>PELPDFFQGKHFFLYGEFPGDERRKLIRYVTAFNGELEDYMSDRV<br>QFVITAQEWDPSFEEALMDNPSLAFVRPRWIYSCNEKQKLLPHQL<br>YGVVPQASGGS**SSETGPVAVDPTLRRRIEPHEFEVFFDPRELRKE**<br>**TCLLYEINWGGRHSIWRHTSQNTNKHVEVNFIEKFTTERYFCPNT**<br>**RCSITWFLSWSPCGECSRAITEFLSRYPHVTLFIYIARLYHHADPR**<br>**NRQGLRDLISSGVTIQIMTEQESGYCWRNFVNYSPSNEAHWPRY**<br>**PHLWVRLYVLELYCIILGLPPCLNILRRKQPQLTFFTIALQSCHYQ**<br>**RLPPHILWATGLK**SGSETPGTSESATPES[DKKYSIGLAIGTNSVG<br>WAVITDEYKVPSKKFKVLGNTDRHSIKKNLIGALLFDSGETAEATRL<br>KRTARRRYTRRKNRICYLQEIFSNEMAKVDDSFFHRLEESFLVEED<br>KKHERHPIFGNIVDEVAYHEKYPTIYHLRKKLVDSTDKADLRLIYLA<br>LAHMIKFRGHFLIEGDLNPDNSDVDKLFIQLVQTYNQLFEENPINAS<br>GVDAKAILSARLSKSRRLENLIAQLPGEKKNGLFGNLIALSLGLTPN<br>FKSNFDLAEDAKLQLSKDTYDDDLDNLLAQIGDQYADLFLAAKNLS<br>DAILLSDILRVNTEITKAPLSASMIKRYDEHHQDLTLLKALVRQQLPE<br>KYKEIFFDQSKNGYAGYIDGGASQEEFYKFIKPILEKMDGTEELLVK<br>LNREDLLRKQRTFDNGSIPHQIHLGELHAILRRQEDFYPFLKDNRE<br>KIEKILTFRIPYYVGPLARGNSRFAWMTRKSEETITPWNFEEVVDK<br>GASAQSFIERMTNFDKNLPNEKVLPKHSLLYEYFTVYNELTKVKYV<br>TEGMRKPAFLSGEQKKAIVDLLFKTNRKVTVKQLKEDYFKKIECFD<br>SVEISGVEDRFNASLGTYHDLLKIIKDKDFLDNEENEDILEDIVLTLT<br>LFEDREMIEERLKTYAHLFDDKVMKQLKRRRYTGWGRLSRKLINGI<br>RDKQSGKTILDFLKSDGFANRNFMQLIHDDSLTFKEDIQKAQVSG<br>QGDSLHEHIANLAGSPAIKKGILQTVKVVDELVKVMGRHKPENIVIE<br>MARENQTTQKGQKNSRERMKRIEEGIKELGSQILKEHPVENTQLQ<br>NEKLYLYYLQNGRDMYVDQELDINRLSDYDVDHIVPQSFLKDDSID<br>NKVLTRSDKNRGKSDNVPSEEVVKKMKNYWRQLLNAKLITQRKF<br>DNLTKAERGGLSELDKAGFIKRQLVETRQITKHVAQILDSRMNTKY<br>DENDKLIREVKVITLKSKLVSDFRKDFQFYKVREINNYHHAHDAYL<br>NAVVGTALIKKYPKLESEFVYGDYKVYDVRKMIAKSEQEIGKATAK<br>YFFYSNIMNFFKTEITLANGEIRKRPLIETNGETGEIVWDKGRDFAT<br>VRKVLSMPQVNIVKKTEVQTGGFSKESILPKRNSDKLIARKKDWDP<br>KKYGGFDSPTVAYSVLVVAKVEKGKSKKLKSVKELLGITIMERSSF<br>EKNPIDFLEAKGYKEVKKDLIIKLPKYSLFELENGRKRMLASAGELQ<br>KGNELALPSKYVNFLYLASHYEKLKGSPEDNEQKQLFVEQHKHYL<br>DEIIEQISEFSKRVILADANLDKVLSAYNKHRDKPIREQAENIIHLFTL<br>TNLGAPAAFKYFDTTIDRKRYTSTKEVLDATLIHQSITGLYETRIDLS<br>QLGGD]SGGSPKKKRKV |
| 62 | Amino acid sequence of ACX, hLIG3 (Apobec is in bold; nCas9 is in parentheses | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR |

-continued

| SEQ ID NO: | Name | Sequence |
|---|---|---|
| | [ ];hLIG3 is underlined) | RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKAAGTPKKKAVVQAKLTTTGQVTSPVKGASFVTSTNPRKFSGF<br>SAKPNNSGEAPSSPTPKRSLSSSKCDPRHKDCLLREFRKLCAMV<br>ADNPSYNTKTQIIQDFLRKGSAGDGFHGDVYLTVKLLLPGVIKTVY<br>NLNDKQIVKLFSRIFNCNPDDMARDLEQGDVSETIRVFFEQSKSFP<br>PAAKSLLTIQEVDEFLLRLSKLTKEDEQQQALQDIASRCTANDLKCI<br>IRLIKHDLKMNSGAKHVLDALDPNAYEAFKASRNLQDVVERVLHNA<br>QEVEKEPGQRRALSVQASLMTPVQPMLAEACKSVEYAMKKCPN<br>GMFSEIKYDGERVQVHKNGDHFSYFSRSLKPVLPHKVAHFKDYIP<br>QAFPGGHSMILDSEVLLIDNKTGKPLPFGTLGVHKKAAFQDANVCL<br>FVFDCIYFNDVSLMDRPLCERRKFLHDNMVEIPNRIMFSEMKRVTK<br>ALDLADMITRVIQEGLEGLVLKDVKGTYEPGKRHWLKVKKDYLNE<br>GAMADTADLVVLGAFYGQGSKGGMMSIFLMGCYDPGSQKWCTV<br>TKCAGGHDDATLARLQNELDMVKISKDPSKIPSWLKVNKIYYPDFI<br>VPDPKKAAVWEITGAEFSKSEAHTADGISIRFPRCTRIRDDKDWKS<br>ATNLPQLKELYQLSKEKADFTVVAGDEGSSTTGGSSEENKGPSG<br>SAVSRKAPSKPSASTKKAEGKLSNSNSKDGNMQTAKPSAMKVGE<br>KLATKSSPVKVGEKRKAADETLCQTKVLLDIFTGVRLYLPPSTPDF<br>SRLRRYFVAFDGDLVQEFDMTSATHVLGSRDKNPAAQQVSPEWI<br>WACIRKRRLVAPCSGGSPKKKRKV |
| 63 | Amino acid sequence of ACX, hLIG3, wtCas9 (Apobec is in bold; wtCas9 is in parentheses [ ];hLIG3 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLDIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK |

-continued

| SEQ ID NO: | Name | Sequence |
|---|---|---|
| | | YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SSKAAGTPKKKAVVQAKLTTTGQVTSPVKGASFVTSTNPRKFSGF<br>SAKPNNSGEAPSSPTPKRSLSSSKCDPRHKDCLLREFRKLCAMV<br>ADNPSYNTKTQIIQDFLRKGSAGDGFHGDVYLTVKLLLPGVIKTVY<br>NLNDKQIVKLFSRIFNCNPDDMARDLEQGDVSETIRVFFEQSKSFP<br>PAAKSLLTIQEVDEFLLRLSKLTKEDEQQQALQDIASRCTANDLKCI<br>IRLIKHDLKMNSGAKHVLDALDPNAYEAFKASRNLQDVVERVLHNA<br>QEVEKEPGQRRALSVQASLMTPVQPMLAEACKSVEYAMKKCPN<br>GMFSEIKYDGERVQVHKNGDHFSYFSRSLKPVLPHKVAHFKDYIP<br>QAFPGGHSMILDSEVLLIDNKTGKPLPFGTLGVHKKAAFQDANVCL<br>FVFDCIYFNDVSLMDRPLCERRKFLHDNMVEIPNRIMFSEMKRVTK<br>ALDLADMITRVIQEGLEGLVLKDVKGTYEPGKRHWLKVKKDYLNE<br>GAMADTADLVVLGAFYGQGSKGGMMSIFLMGCYDPGSQKWCTV<br>TKCAGGHDDATLARLQNELDMVKISKDPSKIPSWLKVNKIYYPDFI<br>VPDPKKAAVWEITGAEFSKSEAHTADGISIRFPRCTRIRDDKDWKS<br>ATNLPQLKELYQLSKEKADFTVVAGDEGSSTTGGSSEENKGPSG<br>SAVSRKAPSKPSASTKKAEGKLSNSNSKDGNMQTAKPSAMKVGE<br>KLATKSSPVKVGEKRKAADETLCQTKVLLDIFTGVRLYLPPSTPDF<br>SRLRRYFVAFDGDLVQEFDMTSATHVLGSRDKNPAAQQVSPEWI<br>WACIRKRRLVAPCSGGSPKKKRKV |
| 64 | Amino acid sequence of AXC, hLIG3 (Apobec is in bold; nCas9 is in parentheses [ ];hLIG3 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSSKAAGTPKKKAVVQAKLTTTGQVTSPVKGASFVTSTNPR<br>KFSGFSAKPNNSGEAPSSPTPKRSLSSSKCDPRHKDCLLREFRKL<br>CAMVADNPSYNTKTQIIQDFLRKGSAGDGFHGDVYLTVKLLLPGVI<br>KTVYNLNDKQIVKLFSRIFNCNPDDMARDLEQGDVSETIRVFFEQS<br>KSFPPAAKSLLTIQEVDEFLLRLSKLTKEDEQQQALQDIASRCTAN<br>DLKCHRLIKHDLKMNSGAKHVLDALDPNAYEAFKASRNLQDVVER<br>VLHNAQEVEKEPGQRRALSVQASLMTPVQPMLAEACKSVEYAMK<br>KCPNGMFSEIKYDGERVQVHKNGDHFSYFSRSLKPVLPHKVAHF<br>KDYIPQAFPGGHSMILDSEVLLIDNKTGKPLPFGTLGVHKKAAFQD<br>ANVCLFVFDCIYFNDVSLMDRPLCERRKFLHDNMVEIPNRIMFSEM<br>KRVTKALDLADMITRVIQEGLEGLVLKDVKGTYEPGKRHWLKVKK<br>DYLNEGAMADTADLVVLGAFYGQGSKGGMMSIFLMGCYDPGSQ<br>KWCTVTKCAGGHDDATLARLQNELDMVKISKDPSKIPSWLKVNKI<br>YYPDFIVPDPKKAAVWEITGAEFSKSEAHTADGISIRFPRCTRIRDD<br>KDWKSATNLPQLKELYQLSKEKADFTVVAGDEGSSTTGGSSEEN<br>KGPSGSAVSRKAPSKPSASTKKAEGKLSNSNSKDGNMQTAKPSA<br>MKVGEKLATKSSPVKVGEKRKAADETLCQTKVLLDIFTGVRLYLPP<br>STPDFSRLRRYFVAFDGDLVQEFDMTSATHVLGSRDKNPAAQQV<br>SPEWIWACIRKRRLVAPCSGSETPGTSESATPESfDKKYSIGLAIGT<br>NSVGWAVITDEYKVPSKKFKVLGNTDRHSIKKNLIGALLFDSGETA<br>EATRLKRTARRRYTRRKNRICYLQEIFSNEMAKVDDSFFHRLEESF<br>LVEEDKKHERHPIFGNIVDEVAYHEKYPTIYHLRKKLVDSTDKADL<br>RLIYLALAHMIKFRGHFLIEGDLNPDNSDVDKLFIQLVQTYNQLFEE<br>NPINASGVDAKAILSARLSKSRRLENLIAQLPGEKKNGLFGNLIALS<br>LGLTPNFKSNFDLAEDAKLQLSKDTYDDDLDNLLAQIGDQYADLFL<br>AAKNLSDAILLSDILRVNTEITKAPLSASMIKRYDEHHQDLTLLKALV<br>RQQLPEKYKEIFFDQSKNGYAGYIDGGASQEEFYKFIKPILEKMDG<br>TEELLVKLNREDLLRKQRTFDNGSIPHQIHLGELHAILRRQEDFYPF<br>LKDNREKIEKILTFRIPYYVGPLARGNSRFAWMTRKSEETITPWNF<br>EEVVDKGASAQSFIERMTNFDKNLPNEKVLPKHSLLYEYFTVYNEL<br>TKVKYVTEGMRKPAFLSGEQKKAIVDLLFKTNRKVTVKQLKEDYFK<br>KIECFDSVEISGVEDRFNASLGTYHDLLKIIKDKDFLDNEENEDILED<br>IVLTLTLFEDREMIEERLKTYAHLFDDKVMKQLKRRRYTGWGRLSR<br>KLINGIRDKQSGKTILDFLKSDGFANRNFMQLIHDDSLTFKEDIQKA<br>QVSGQGDSLHEHIANLAGSPAIKKGILQTVKVVDELVKVMGRHKP<br>ENIVIEMARENQTTQKGQKNSRERMKRIEEGIKELGSQILKEHPVE<br>NTQLQNEKLYLYYLQNGRDMYVDQELDINRLSDYDVDHIVPQSFL<br>KDDSIDNKVLTRSDKNRGKSDNVPSEEVVKKMKNYWRQLLNAKLI<br>TQRKFDNLTKAERGGLSELDKAGFIKRQLVETRQITKHVAQILDSR<br>MNTKYDENDKLIREVKVITLKSKLVSDFRKDFQFYKVREINNYHHA<br>HDAYLNAVVGTALIKKYPKLESEFVYGDYKVYDVRKMIAKSEQEIG<br>KATAKYFFYSNIMNFFKTEITLANGEIRKRPLIETNGETGEIVWDKG |

-continued

| SEQ ID NO: | Name | Sequence |
|---|---|---|
| | | RDFATVRKVLSMPQVNIVKKTEVQTGGFSKESILPKRNSDKLIARK<br>KDWDPKKYGGFDSPTVAYSVLVVAKVEKGKSKKLKSVKELLGITIM<br>ERSSFEKNPIDFLEAKGYKEVKKDLIIKLPKYSLFELENGRKRMLAS<br>AGELQKGNELALPSKYVNFLYLASHYEKLKGSPEDNEQKQLFVEQ<br>HKHYLDEIIEQISEFSKRVILADANLDKVLSAYNKHRDKPIREQAENI<br>IHLFTLTNLGAPAAFKYFDTTIDRKRYTSTKEVLDATLIHQSITGLYE<br>TRIDLSQLGGD]SGGSPKKKRKV |
| 65 | Amino acid sequence of XAC, hLIG3 (Apobec is in bold; nCas9 is in parentheses [ ];hLIG3 is underlined) | MSKAAGTPKKKAVVQAKLTTTGQVTSPVKGASFVTSTNPRKFSGF<br>SAKPNNSGEAPSSPTPKRSLSSSKCDPRHKDCLLREFRKLCAMV<br>ADNPSYNTKTQIIQDFLRKGSAGDGFHGDVYLTVKLLLPGVIKTVY<br>NLNDKQIVKLFSRIFNCNPDDMARDLEQGDVSETIRVFFEQSKSFP<br>PAAKSLLTIQEVDEFLLRLSKLTKEDEQQQALQDIASRCTANDLKCI<br>IRLIKHDLKMNSGAKHVLDALDPNAYEAFKASRNLQDVVERVLHNA<br>QEVEKEPGQRRALSVQASLMTPVQPMLAEACKSVEYAMKKCPN<br>GMFSEIKYDGERVQVHKNGDHFSYFSRSLKPVLPHKVAHFKDYIP<br>QAFPGGHSMILDSEVLLIDNKTGKPLPFGTLGVHKKAAFQDANVCL<br>FVFDCIYFNDVSLMDRPLCERRKFLHDNMVEIPNRIMFSEMKRVTK<br>ALDLADMITRVIQEGLEGLVLKDVKGTYEPGKRHWLKVKKDYLNE<br>GAMADTADLVVLGAFYGQGSKGGMMSIFLMGCYDPGSQKWCTV<br>TKCAGGHDDATLARLQNELDMVKISKDPSKIPSWLKVNKIYYPDFI<br>VPDPKKAAVWEITGAEFSKSEAHTADGISIRFPRCTRIRDDKDWKS<br>ATNLPQLKELYQLSKEKADFTVVAGDEGSSTTGGSSEENKGPSG<br>SAVSRKAPSKPSASTKKAEGKLSNSNSKDGNMQTAKPSAMKVGE<br>KLATKSSPVKVGEKRKAADETLCQTKVLLDIFTGVRLYLPPSTPDF<br>SRLRRYFVAFDGDLVQEFDMTSATHVLGSRDKNPAAQQVSPEWI<br>WACIRKRRLVAPCSGGS**SSETGPVAVDPTLRRRIEPHEFEVFFDP**<br>**RELRKETCLLYEINWGGRHSIWRHTSQNTNKHVEVNFIEKFTTER**<br>**YFCPNTRCSITWFLSWSPCGECSRAITEFLSRYPHVTLFIYIARLY**<br>**HHADPRNRQGLRDLISSGVTIQIMTEQESGYCWRNFVNYSPSNE**<br>**AHWPRYPHLWVRLYVLELYCIILGLPPCLNILRRKQPQLTFFTIAL**<br>**QSCHYQRLPPHILWATGLK**SGSETPGTSESATPES[DKKYSIGLAI<br>GTNSVGWAVITDEYKVPSKKFKVLGNTDRHSIKKNLIGALLFDSGE<br>TAEATRLKRTARRRYTRRKNRICYLQEIFSNEMAKVDDSFFHRLEE<br>SFLVEEDKKHERHPIFGNIVDEVAYHEKYPTIYHLRKKLVDSTDKA<br>DLRLIYLALAHMIKFRGHFLIEGDLNPDNSDVDKLFIQLVQTYNQLF<br>EENPINASGVDAKAILSARLSKSRRLENLIAQLPGEKKNGLFGNLIA<br>LSLGLTPNFKSNFDLAEDAKLQLSKDTYDDDLDNLLAQIGDQYADL<br>FLAAKNLSDAILLSDILRVNTEITKAPLSASMIKRYDEHHQDLTLLKA<br>LVRQQLPEKYKEIFFDQSKNGYAGYIDGGASQEEFYKFIKPILEKM<br>DGTEELLVKLNREDLLRKQRTFDNGSIPHQIHLGELHAILRRQEDF<br>YPFLKDNREKIEKILTFRIPYYVGPLARGNSRFAWMTRKSEETITP<br>WNFEEVVDKGASAQSFIERMTNFDKNLPNEKVLPKHSLLYEYFTV<br>YNELTKVKYVTEGMRKPAFLSGEQKKAIVDLLFKTNRKVTVKQLKE<br>DYFKKIECFDSVEISGVEDRFNASLGTYHDLLKIIKDKDFLDNEENE<br>DILEDIVLTLTLFEDREMIEERLKTYAHLFDDKVMKQLKRRRYTGW<br>GRLSRKLINGIRDKQSGKTILDFLKSDGFANRNFMQLIHDDSLTFKE<br>DIQKAQVSGQGDSLHEHIANLAGSPAIKKGILQTVKVVDELVKVMG<br>RHKPENIVIEMARENQTTQKGQKNSRERMKRIEEGIKELGSQILKE<br>HPVENTQLQNEKLYLYYLQNGRDMYVDQELDINRLSDYDVDHIVP<br>QSFLKDDSIDNKVLTRSDKNRGKSDNVPSEEVVKKMKNYWRQLL<br>NAKLITQRKFDNLTKAERGGLSELDKAGFIKRQLVETRQITKHVAQI<br>LDSRMNTKYDENDKLIREVKVITLKSKLVSDFRKDFQFYKVREINN<br>YHHAHDAYLNAVVGTALIKKYPKLESEFVYGDYKVYDVRKMIAKSE<br>QEIGKATAKYFFYSNIMNFFKTEITLANGEIRKRPLIETNGETGEIVW<br>DKGRDFATVRKVLSMPQVNIVKKTEVQTGGFSKESILPKRNSDKLI<br>ARKKDWDPKKYGGFDSPTVAYSVLVVAKVEKGKSKKLKSVKELL<br>GITIMERSSFEKNPIDFLEAKGYKEVKKDLIIKLPKYSLFELENGRKR<br>MLASAGELQKGNELALPSKYVNFLYLASHYEKLKGSPEDNEQKQL<br>FVEQHKHYLDEIIEQISEFSKRVILADANLDKVLSAYNKHRDKPIRE<br>QAENIIHLFTLTNLGAPAAFKYFDTTIDRKRYTSTKEVLDATLIHQSI<br>TGLYETRIDLSQLGGD]SGGSPKKKRKV |
| 66 | Amino acid sequence of ACX, rLIG3 (Apobec is in bold; nCas9 is in parentheses [ ]; rLIG3 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV |

-continued

| SEQ ID NO: | Name | Sequence |
|---|---|---|
| | | NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>STLAFKTLFPRNLCALGRKELCLFSEQHHWPAIRQFSQWSETNLL<br>CGCCLLQRRKPVLSFQRGHLRPRATHLISWSGSHVGLCTGPCEM<br>AEQRFCVDYAKRGTAGCKKCKEKIVKGVCRIGKVVPNPFSESGG<br>DMKEWYHIKCMFEKLERARATTKKIEDLTELEGWEELEDNEKEQI<br>SQHIADLSSKTAATPKKKATVQAKLTTTGQVTSPVKGASFITSTNP<br>RKFSGFSAAKPNNSEQDPSSPAPKTSLSASKCDPKHKDCLLREFR<br>KLCAMVAENPSYNTKTQIIHDFLQKGSTGDGFRGDVYLTVKLLLPG<br>VIKSVYNLNDKQIVKLFSRIFNCNPDDMARDLEQGDVSETIRVFFE<br>QSKSFPPAAKSLLTIQEVDAFLLHLSKLTKEDEQQQALQDIASRCT<br>ANDLKCIIRLIKHDLKMNSGAKHVLDALDPNAYEAFKASRNLQDVV<br>ERVLHNEQEVEKDPGRRRALSVQASLMTPVQPMLAEACKSIEYA<br>MKKCPNGMFSEIKYDGERVQVHKKGDHFSYFSRSLKPVLPHKVA<br>HFKDYIPKAFPGGQSMILDSEVLLIDNNTGKPLPFGTLGVHKKAAF<br>QDANVCLFVFDCIYFNDVSLMDRPLCERRKFLHDNMVEIRNRIMF<br>SEMKQVTKASDLADMINRVIREGLEGLVLKDVKGTYEPGKRHWLK<br>VKKDYLNEGAMADTADLVVLGAFYGQGSKGGMMSIFLMGCYDPD<br>SQKWCTVTKCAGGHDDATLARLQKELDMVKISKDPSKIPSWLKIN<br>KIYYPDFIVPDPKKAAVWEITGAEFSRSEAHTADGISIRFPRCTRIR<br>DDKDWKSATNLPQLKELYQLSKDKADFAVVAGDEGSSTTGGSNG<br>ENEGTAGSTVPRKGPKGPPSKSSASAKKTEQKLNDPSSRGGEKL<br>AVKSSPVKVGMKRKAADETPGLTKRRRASRQRGRRAMRTGRRS<br>GGSPKKKRKV |
| 67 | Amino acid sequence of ACX, rLIG3, wtCas9 (Apobec is in bold; wtCas9 is in parentheses [ ]; rLIG3 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLDIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV |

-continued

| SEQ ID NO: | Name | Sequence |
|---|---|---|
| | | NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>STLAFKTLFPRNLCALGRKELCLFSEQHHWPAIRQFSQWSETNLL<br>CGCCLLQRRKPVLSFQRGHLRPRATHLISWSGSHVGLCTGPCEM<br>AEQRFCVDYAKRGTAGCKKCKEKIVKGVCRIGKVVPNPFSESGG<br>DMKEWYHIKCMFEKLERARATTKKIEDLTELEGWEELEDNEKEQI<br>SQHIADLSSKTAATPKKKATVQAKLTTTGQVTSPVKGASFITSTNP<br>RKFSGFSAAKPNNSEQDPSSPAPKTSLSASKCDPKHKDCLLREFR<br>KLCAMVAENPSYNTKTQIIHDFLQKGSTGDGFRGDVYLTVKLLLPG<br>VIKSVYNLNDKQIVKLFSRIFNCNPDDMARDLEQGDVSETIRVFFE<br>QSKSFPPAAKSLLTIQEVDAFLLHLSKLTKEDEQQQALQDIASRCT<br>ANDLKCIIRLIKHDLKMNSGAKHVLDALDPNAYEAFKASRNLQDVV<br>ERVLHNEQEVEKDPGRRRALSVQASLMTPVQPMLAEACKSIEYA<br>MKKCPNGMFSEIKYDGERVQVHKKGDHFSYFSRSLKPVLPHKVA<br>HFKDYIPKAFPGGQSMILDSEVLLIDNNTGKPLPFGTLGVHKKAAF<br>QDANVCLFVFDCIYFNDVSLMDRPLCERRKFLHDNMVEIRNRIMF<br>SEMKQVTKASDLADMINRVIREGLEGLVLKDVKGTYEPGKRHWLK<br>VKKDYLNEGAMADTADLVVLGAFYGQGSKGGMMSIFLMGCYDPD<br>SQKWCTVTKCAGGHDDATLARLQKELDMVKISKDPSKIPSWLKIN<br>KIYYPDFIVPDPKKAAVWEITGAEFSRSEAHTADGISIRFPRCTRIR<br>DDKDWKSATNLPQLKELYQLSKDKADFAVVAGDEGSSTTGGSNG<br>ENEGTAGSTVPRKGPKGPPSKSSASAKKTEQKLNDPSSRGGEKL<br>AVKSSPVKVGMKRKAADETPGLTKRRRASRQRGRRAMRTGRRS<br>GGSPKKKRKV |
| 68 | Amino acid sequence of XAC, rLIG3 (Apobec is in bold; nCas9 is in parentheses [ ]; rLIG3 is underlined) | MTLAFKTLFPRNLCALGRKELCLFSEQHHWPAIRQFSQWSETNLL<br>CGCCLLQRRKPVLSFQRGHLRPRATHLISWSGSHVGLCTGPCEM<br>AEQRFCVDYAKRGTAGCKKCKEKIVKGVCRIGKVVPNPFSESGG<br>DMKEWYHIKCMFEKLERARATTKKIEDLTELEGWEELEDNEKEQI<br>SQHIADLSSKTAATPKKKATVQAKLTTTGQVTSPVKGASFITSTNP<br>RKFSGFSAAKPNNSEQDPSSPAPKTSLSASKCDPKHKDCLLREFR<br>KLCAMVAENPSYNTKTQIIHDFLQKGSTGDGFRGDVYLTVKLLLPG<br>VIKSVYNLNDKQIVKLFSRIFNCNPDDMARDLEQGDVSETIRVFFE<br>QSKSFPPAAKSLLTIQEVDAFLLHLSKLTKEDEQQQALQDIASRCT<br>ANDLKCHRLIKHDLKMNSGAKHVLDALDPNAYEAFKASRNLQDVV<br>ERVLHNEQEVEKDPGRRRALSVQASLMTPVQPMLAEACKSIEYA<br>MKKCPNGMFSEIKYDGERVQVHKKGDHFSYFSRSLKPVLPHKVA<br>HFKDYIPKAFPGGQSMILDSEVLLIDNNTGKPLPFGTLGVHKKAAF<br>QDANVCLFVFDCIYFNDVSLMDRPLCERRKFLHDNMVEIRNRIMF<br>SEMKQVTKASDLADMINRVIREGLEGLVLKDVKGTYEPGKRHWLK<br>VKKDYLNEGAMADTADLVVLGAFYGQGSKGGMMSIFLMGCYDPD<br>SQKWCTVTKCAGGHDDATLARLQKELDMVKISKDPSKIPSWLKIN<br>KIYYPDFIVPDPKKAAVWEITGAEFSRSEAHTADGISIRFPRCTRIR<br>DDKDWKSATNLPQLKELYQLSKDKADFAVVAGDEGSSTTGGSNG<br>ENEGTAGSTVPRKGPKGPPSKSSASAKKTEQKLNDPSSRGGEKL<br>AVKSSPVKVGMKRKAADETPGLTKRRRASRQRGRRAMRTGRRS<br>GGS**SSETGPVAVDPTLRRRIEPHEFEVFFDPRELRKETCLLYEIN**<br>**WGGRHSIWRHTSQNTNKHVEVNFIEKFTTERYFCPNTRCSITWFL**<br>**SWSPCGECSRAITEFLSRYPHVTLFIYIARLYHHADPRNRQGLRD**<br>**LISSGVTIQIMTEQESGYCWRNFVNYSPSNEAHWPRYPHLWVRL**<br>**YVLELYCIILGLPPCLNILRRKQPQLTFFTIALQSCHYQRLPPHILW**<br>**ATGLK**SGSETPGTSESATPES[DKKYSIGLAIGTNSVGWAVITDEY<br>KVPSKKFKVLGNTDRHSIKKNLIGALLFDSGETAEATRLKRTARRR<br>YTRRKNRICYLQEIFSNEMAKVDDSFFHRLEESFLVEEDKKHERHP<br>IFGNIVDEVAYHEKYPTIYHLRKKLVDSTDKADLRLIYLALAHMIKFR<br>GHFLIEGDLNPDNSDVDKLFIQLVQTYNQLFEENPINASGVDAKAIL<br>SARLSKSRRLENLIAQLPGEKKNGLFGNLIALSLGLTPNFKSNFDLA<br>EDAKLQLSKDTYDDDLDNLLAQIGDQYADLFLAAKNLSDAILLSDIL<br>RVNTEITKAPLSASMIKRYDEHHQDLTLLKALVRQQLPEKYKEIFFD<br>QSKNGYAGYIDGGASQEEFYKFIKPILEKMDGTEELLVKLNREDLL<br>RKQRTFDNGSIPHQIHLGELHAILRRQEDFYPFLKDNREKIEKILTF<br>RIPYYVGPLARGNSRFAWMTRKSEETITPWNFEEVVDKGASAQSF<br>IERMTNFDKNLPNEKVLPKHSLLYEYFTVYNELTKVKYVTEGMRKP<br>AFLSGEQKKAIVDLLFKTNRKVTVKQLKEDYFKKIECFDSVEISGVE<br>DRFNASLGTYHDLLKIIKDKDFLDNEENEDILEDIVLTLTLFEDREMI<br>EERLKTYAHLFDDKVMKQLKRRRYTGWGRLSRKLINGIRDKQSGK<br>TILDFLKSDGFANRNFMQLIHDDSLTFKEDIQKAQVSGQGDSLHEH<br>IANLAGSPAIKKGILQTVKVVDELVKVMGRHKPENIVIEMARENQTT<br>QKGQKNSRERMKRIEEGIKELGSQILKEHPVENTQLQNEKLYLYYL<br>QNGRDMYVDQELDINRLSDYDVDHIVPQSFLKDDSIDNKVLTRSD<br>KNRGKSDNVPSEEVVKKMKNYWRQLLNAKLITQRKFDNLTKAER |

-continued

| SEQ ID NO: | Name | Sequence |
|---|---|---|
| | | GGLSELDKAGFIKRQLVETRQITKHVAQILDSRMNTKYDENDKLIR<br>EVKVITLKSKLVSDFRKDFQFYKVREINNYHHAHDAYLNAVVGTALI<br>KKYPKLESEFVYGDYKVYDVRKMIAKSEQEIGKATAKYFFYSNIMN<br>FFKTEITLANGEIRKRPLIETNGETGEIVWDKGRDFATVRKVLSMP<br>QVNIVKKTEVQTGGFSKESILPKRNSDKLIARKKDWDPKKYGGFD<br>SPTVAYSVLVVAKVEKGKSKKLKSVKELLGITIMERSSFEKNPIDFL<br>EAKGYKEVKKDLIIKLPKYSLFELENGRKRMLASAGELQKGNELAL<br>PSKYVNFLYLASHYEKLKGSPEDNEQKQLFVEQHKHYLDEIIEQIS<br>EFSKRVILADANLDKVLSAYNKHRDKPIREQAENIIHLFTLTNLGAP<br>AAFKYFDTTIDRKRYTSTKEVLDATLIHQSITGLYETRIDLSQLGGD]<br>SGGSPKKKRKV |
| 69 | Amino acid sequence of ACX, rXRCC1 (Apobec is in bold; nCas9 is in parentheses [ ]; rXRCC1 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLAIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV<br>NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SPEISLRHVVSCSSQDSTHRAENLLKADTYRKWRSAKAGEKTISV<br>VLQLEKEEQIHSVDIGNDGSAFVEVLVGSSAGGATAGEQDYEVLL<br>VTSSFMSPSESRSGSNPNRVRIFGPDKLVRAAAEKRWDRVKIVCS<br>QPYSKDSPYGLSFVKFHSPPDKDEAEAPSQKVTVTKLGQFRVKEE<br>DDSANSLRPGALFFNRINKAASASASDPAGPSYAAATLQASSAAS<br>SALPVPKVGGSSSKLQEPPKGKRKLDLGLEDSKPPSKPSAGPAAL<br>KRPKLPVPSRTPAATPASTPAQKAVPGKPRGEGTEPRGARAGPQ<br>ELGKILQGVVVVLSGFQNPFRSELRDKALELGAKYRPDWTPDSTH<br>LICAFANTPKYSQVLGLGGRIVRKEWVLDCYRMRRRLPSRRYLMA<br>GLGSSSEDEGDSHSESGEDEAPKLPRKRPQPKAKTQAAGPSSPP<br>RPPTPEETKAPSPGPQDNSDTDGEQSEGRDNGAEDSGDTEDEL<br>RRVAKQREQRQPPAPEENGEDPYAGSTDENTDSEAPSEADLPIP<br>ELPDFFQGKHFFLYGEFPGDERRKLIRYVTAFNGELEDYMSDRVQ<br>FVITAQEWDPNFEEALMENPSLAFVRPRWIYSCNEKQKLLPHQLY<br>GVVPQASGGSPKKKRKV |
| 70 | Amino acid sequence of ACX, rXRCC1, wtCas9 (Apobec is in bold; wtCas9 is in parentheses [ ]; rXRCC1 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGSETPGTSESATPES[DKKYSIGLDIGTNSVGWAVITDEYKVP<br>SKKFKVLGNTDRHSIKKNLIGALLFDSGETAEATRLKRTARRRYTR<br>RKNRICYLQEIFSNEMAKVDDSFFHRLEESFLVEEDKKHERHPIFG<br>NIVDEVAYHEKYPTIYHLRKKLVDSTDKADLRLIYLALAHMIKFRGH<br>FLIEGDLNPDNSDVDKLFIQLVQTYNQLFEENPINASGVDAKAILSA<br>RLSKSRRLENLIAQLPGEKKNGLFGNLIALSLGLTPNFKSNFDLAED<br>AKLQLSKDTYDDDLDNLLAQIGDQYADLFLAAKNLSDAILLSDILRV |

-continued

| SEQ ID NO: | Name | Sequence |
|---|---|---|
| | | NTEITKAPLSASMIKRYDEHHQDLTLLKALVRQQLPEKYKEIFFDQS<br>KNGYAGYIDGGASQEEFYKFIKPILEKMDGTEELLVKLNREDLLRK<br>QRTFDNGSIPHQIHLGELHAILRRQEDFYPFLKDNREKIEKILTFRIP<br>YYVGPLARGNSRFAWMTRKSEETITPWNFEEVVDKGASAQSFIER<br>MTNFDKNLPNEKVLPKHSLLYEYFTVYNELTKVKYVTEGMRKPAF<br>LSGEQKKAIVDLLFKTNRKVTVKQLKEDYFKKIECFDSVEISGVEDR<br>FNASLGTYHDLLKIIKDKDFLDNEENEDILEDIVLTLTLFEDREMIEE<br>RLKTYAHLFDDKVMKQLKRRRYTGWGRLSRKLINGIRDKQSGKTI<br>LDFLKSDGFANRNFMQLIHDDSLTFKEDIQKAQVSGQGDSLHEHIA<br>NLAGSPAIKKGILQTVKVVDELVKVMGRHKPENIVIEMARENQTTQ<br>KGQKNSRERMKRIEEGIKELGSQILKEHPVENTQLQNEKLYLYYLQ<br>NGRDMYVDQELDINRLSDYDVDHIVPQSFLKDDSIDNKVLTRSDK<br>NRGKSDNVPSEEVVKKMKNYWRQLLNAKLITQRKFDNLTKAERG<br>GLSELDKAGFIKRQLVETRQITKHVAQILDSRMNTKYDENDKLIREV<br>KVITLKSKLVSDFRKDFQFYKVREINNYHHAHDAYLNAVVGTALIKK<br>YPKLESEFVYGDYKVYDVRKMIAKSEQEIGKATAKYFFYSNIMNFF<br>KTEITLANGEIRKRPLIETNGETGEIVWDKGRDFATVRKVLSMPQV<br>NIVKKTEVQTGGFSKESILPKRNSDKLIARKKDWDPKKYGGFDSPT<br>VAYSVLVVAKVEKGKSKKLKSVKELLGITIMERSSFEKNPIDFLEAK<br>GYKEVKKDLIIKLPKYSLFELENGRKRMLASAGELQKGNELALPSK<br>YVNFLYLASHYEKLKGSPEDNEQKQLFVEQHKHYLDEIIEQISEFS<br>KRVILADANLDKVLSAYNKHRDKPIREQAENIIHLFTLTNLGAPAAF<br>KYFDTTIDRKRYTSTKEVLDATLIHQSITGLYETRIDLSQLGGD]SGG<br>SPEISLRHVVSCSSQDSTHRAENLLKADTYRKWRSAKAGEKTISV<br>VLQLEKEEQIHSVDIGNDGSAFVEVLVGSSAGGATAGEQDYEVLL<br>VTSSFMSPSESRSGSNPNRVRIFGPDKLVRAAAEKRWDRVKIVCS<br>QPYSKDSPYGLSFVKFHSPPDKDEAEAPSQKVTVTKLGQFRVKEE<br>DDSANSLRPGALFFNRINKAASASASDPAGPSYAAATLQASSAAS<br>SALPVPKVGGSSSKLQEPPKGKRKLDLGLEDSKPPSKPSAGPAAL<br>KRPKLPVPSRTPAATPASTPAQKAVPGKPRGEGTEPRGARAGPQ<br>ELGKILQGVVVVLSGFQNPFRSELRDKALELGAKYRPDWTPDSTH<br>LICAFANTPKYSQVLGLGGRIVRKEWVLDCYRMRRRLPSRRYLMA<br>GLGSSSEDEGDSHSESGEDEAPKLPRKRPQPKAKTQAAGPSSPP<br>RPPTPEETKAPSPGPQDNSDTDGEQSEGRDNGAEDSGDTEDEL<br>RRVAKQREQRQPPAPEENGEDPYAGSTDENTDSEAPSEADLPIP<br>ELPDFFQGKHFFLYGEFPGDERRKLIRYVTAFNGELEDYMSDRVQ<br>FVITAQEWDPNFEEALMENPSLAFVRPRWIYSCNEKQKLLPHQLY<br>GVVPQASGGSPKKKRKV |
| 71 | Amino acid sequence of AXC, rXRCC1 (Apobec is in bold; nCas9 is in parentheses [ ]; rXRCC1 is underlined) | **MSSETGPVAVDPTLRRRIEPHEFEVFFDPRELRKETCLLYEINWG**<br>**GRHSIWRHTSQNTNKHVEVNFIEKFTTERYFCPNTRCSITWFLSW**<br>**SPCGECSRAITEFLSRYPHVTLFIYIARLYHHADPRNRQGLRDLIS**<br>**SGVTIQIMTEQESGYCWRNFVNYSPSNEAHWPRYPHLWVRLYVL**<br>**ELYCIILGLPPCLNILRRKQPQLTFFTIALQSCHYQRLPPHILWATG**<br>**LK**SGGSPEISLRHVVSCSSQDSTHRAENLLKADTYRKWRSAKAG<br>EKTISVVLQLEKEEQIHSVDIGNDGSAFVEVLVGSSAGGATAGEQD<br>YEVLLVTSSFMSPSESRSGSNPNRVRIFGPDKLVRAAAEKRWDRV<br>KIVCSQPYSKDSPYGLSFVKFHSPPDKDEAEAPSQKVTVTKLGQF<br>RVKEEDDSANSLRPGALFFNRINKAASASASDPAGPSYAAATLQA<br>SSAASSALPVPKVGGSSSKLQEPPKGKRKLDLGLEDSKPPSKPSA<br>GPAALKRPKLPVPSRTPAATPASTPAQKAVPGKPRGEGTEPRGA<br>RAGPQELGKILQGVVVVLSGFQNPFRSELRDKALELGAKYRPDWT<br>PDSTHLICAFANTPKYSQVLGLGGRIVRKEWVLDCYRMRRRLPSR<br>RYLMAGLGSSSEDEGDSHSESGEDEAPKLPRKRPQPKAKTQAAG<br>PSSPPRPPTPEETKAPSPGPQDNSDTDGEQSEGRDNGAEDSGD<br>TEDELRRVAKQREQRQPPAPEENGEDPYAGSTDENTDSEAPSEA<br>DLPIPELPDFFQGKHFFLYGEFPGDERRKLIRYVTAFNGELEDYMS<br>DRVQFVITAQEWDPNFEEALMENPSLAFVRPRWIYSCNEKQKLLP<br>HQLYGVVPQASGSETPGTSESATPES[DKKYSIGLAIGTNSVGWA<br>VITDEYKVPSKKFKVLGNTDRHSIKKNLIGALLFDSGETAEATRLKR<br>TARRRYTRRKNRICYLQEIFSNEMAKVDDSFFHRLEESFLVEEDKK<br>HERHPIFGNIVDEVAYHEKYPTIYHLRKKLVDSTDKADLRLIYLALA<br>HMIKFRGHFLIEGDLNPDNSDVDKLFIQLVQTYNQLFEENPINASG<br>VDAKAILSARLSKSRRLENLIAQLPGEKKNGLFGNLIALSLGLTPNF<br>KSNFDLAEDAKLQLSKDTYDDDLDNLLAQIGDQYADLFLAAKNLSD<br>AILLSDILRVNTEITKAPLSASMIKRYDEHHQDLTLLKALVRQQLPEK<br>YKEIFFDQSKNGYAGYIDGGASQEEFYKFIKPILEKMDGTEELLVKL<br>NREDLLRKQRTFDNGSIPHQIHLGELHAILRRQEDFYPFLKDNREKI<br>EKILTFRIPYYVGPLARGNSRFAWMTRKSEETITPWNFEEVVDKGA<br>SAQSFIERMTNFDKNLPNEKVLPKHSLLYEYFTVYNELTKVKYVTE<br>GMRKPAFLSGEQKKAIVDLLFKTNRKVTVKQLKEDYFKKIECFDSV<br>EISGVEDRFNASLGTYHDLLKIIKDKDFLDNEENEDILEDIVLTLTLF<br>EDREMIEERLKTYAHLFDDKVMKQLKRRRYTGWGRLSRKLINGIR<br>DKQSGKTILDFLKSDGFANRNFMQLIHDDSLTFKEDIQKAQVSGQ<br>GDSLHEHIANLAGSPAIKKGILQTVKVVDELVKVMGRHKPENMEM |

-continued

| SEQ ID NO: | Name | Sequence |
|---|---|---|
| | | ARENQTTQKGQKNSRERMKRIEEGIKELGSQILKEHPVENTQLQN<br>EKLYLYYLQNGRDMYVDQELDINRLSDYDVDHIVPQSFLKDDSIDN<br>KVLTRSDKNRGKSDNVPSEEVVKKMKNYWRQLLNAKLITQRKFD<br>NLTKAERGGLSELDKAGFIKRQLVETRQITKHVAQILDSRMNTKYD<br>ENDKLIREVKVITLKSKLVSDFRKDFQFYKVREINNYHHAHDAYLN<br>AWGTALIKKYPKLESEFVYGDYKVYDVRKMIAKSEQEIGKATAKY<br>FFYSNIMNFFKTEITLANGEIRKRPLIETNGETGEIVWDKGRDFATV<br>RKVLSMPQVNIVKKTEVQTGGFSKESILPKRNSDKLIARKKDWDPK<br>KYGGFDSPTVAYSVLVVAKVEKGKSKKLKSVKELLGITIMERSSFE<br>KNPIDFLEAKGYKEVKKDLIIKLPKYSLFELENGRKRMLASAGELQK<br>GNELALPSKYVNFLYLASHYEKLKGSPEDNEQKQLFVEQHKHYLD<br>EIIEQISEFSKRVILADANLDKVLSAYNKHRDKPIREQAENIIHLFTLT<br>NLGAPAAFKYFDTTIDRKRYTSTKEVLDATLIHQSITGLYETRIDLSQ<br>LGGD]SGGSPKKKRKV |
| 72 | Amino acid sequence of XAC, rXRCC1 (Apobec is in bold; nCas9 is in parentheses [ ]; rXRCC1 is underlined) | MPEISLRHVVSCSSQDSTHRAENLLKADTYRKWRSAKAGEKTISV<br>VLQLEKEEQIHSVDIGNDGSAFVEVLVGSSAGGATAGEQDYEVLL<br>VTSSFMSPSESRSGSNPNRVRIFGPDKLVRAAAEKRWDRVKIVCS<br>QPYSKDSPYGLSFVKFHSPPDKDEAEAPSQKVTVTKLGQFRVKEE<br>DDSANSLRPGALFFNRINKAASASASDPAGPSYAAATLQASSAAS<br>SALPVPKVGGSSSKLQEPPKGKRKLDLGLEDSKPPSKPSAGPAAL<br>KRPKLPVPSRTPAATPASTPAQKAVPGKPRGEGTEPRGARAGPQ<br>ELGKILQGVVVVLSGFQNPFRSELRDKALELGAKYRPDWTPDSTH<br>LICAFANTPKYSQVLGLGGRIVRKEWVLDCYRMRRRLPSRRYLMA<br>GLGSSSEDEGDSHSESGEDEAPKLPRKRPQPKAKTQAAGPSSPP<br>RPPTPEETKAPSPGPQDNSDTDGEQSEGRDNGAEDSGDTEDEL<br>RRVAKQREQRQPPAPEENGEDPYAGSTDENTDSEAPSEADLPIP<br>ELPDFFQGKHFFLYGEFPGDERRKLIRYVTAFNGELEDYMSDRVQ<br>FVITAQEWDPNFEEALMENPSLAFVRPRWIYSCNEKQKLLPHQLY<br>GVVPQASGGS**SSETGPVAVDPTLRRRIEPHEFEVFFDPRELRKET**<br>**CLLYEINWGGRHSIWRHTSQNTNKHVEVNFIEKFTTERYFCPNTR**<br>**CSITWFLSWSPCGECSRAITEFLSRYPHVTLFIYIARLYHHADPRN**<br>**RQGLRDLISSGVTIQIMTEQESGYCWRNFVNYSPSNEAHWPRYP**<br>**HLWVRLYVLELYCIILGLPPCLNILRRKQPQLTFFTIALQSCHYQR**<br>**LPPHILWATGLK**SGSETPGTSESATPES[DKKYSIGLAIGTNSVGW<br>AVITDEYKVPSKKFKVLGNTDRHSIKKNLIGALLFDSGETAEATRLK<br>RTARRRYTRRKNRICYLQEIFSNEMAKVDDSFFHRLEESFLVEEDK<br>KHERHPIFGNIVDEVAYHEKYPTIYHLRKKLVDSTDKADLRLIYLAL<br>AHMIKFRGHFLIEGDLNPDNSDVDKLFIQLVQTYNQLFEENPINAS<br>GVDAKAILSARLSKSRRLENLIAQLPGEKKNGLFGNLIALSLGLTPN<br>FKSNFDLAEDAKLQLSKDTYDDDLDNLLAQIGDQYADLFLAAKNLS<br>DAILLSDILRVNTEITKAPLSASMIKRYDEHHQDLTLLKALVRQQLPE<br>KYKEIFFDQSKNGYAGYIDGGASQEEFYKFIKPILEKMDGTEELLVK<br>LNREDLLRKQRTFDNGSIPHQIHLGELHAILRRQEDFYPFLKDNRE<br>KIEKILTFRIPYYVGPLARGNSRFAWMTRKSEETITPWNFEEVVDK<br>GASAQSFIERMTNFDKNLPNEKVLPKHSLLYEYFTVYNELTKVKYV<br>TEGMRKPAFLSGEQKKAIVDLLFKTNRKVTVKQLKEDYFKKIECFD<br>SVEISGVEDRFNASLGTYHDLLKIIKDKDFLDNEENEDILEDIVLTLT<br>LFEDREMIEERLKTYAHLFDDKVMKQLKRRRYTGWGRLSRKLINGI<br>RDKQSGKTILDFLKSDGFANRNFMQLIHDDSLTFKEDIQKAQVSG<br>QGDSLHEHIANLAGSPAIKKGILQTVKVVDELVKVMGRHKPENIVIE<br>MARENQTTQKGQKNSRERMKRIEEGIKELGSQILKEHPVENTQLQ<br>NEKLYLYYLQNGRDMYVDQELDINRLSDYDVDHIVPQSFLKDDSID<br>NKVLTRSDKNRGKSDNVPSEEVVKKMKNYWRQLLNAKLITQRKF<br>DNLTKAERGGLSELDKAGFIKRQLVETRQITKHVAQILDSRMNTKY<br>DENDKLIREVKVITLKSKLVSDFRKDFQFYKVREINNYHHAHDAYL<br>NAVVGTALIKKYPKLESEFVYGDYKVYDVRKMIAKSEQEIGKATAK<br>YFFYSNIMNFFKTEITLANGEIRKRPLIETNGETGEIVWDKGRDFAT<br>VRKVLSMPQVNIVKKTEVQTGGFSKESILPKRNSDKLIARKKDWDP<br>KKYGGFDSPTVAYSVLVVAKVEKGKSKKLKSVKELLGITIMERSSF<br>EKNPIDFLEAKGYKEVKKDLIIKLPKYSLFELENGRKRMLASAGELQ<br>KGNELALPSKYVNFLYLASHYEKLKGSPEDNEQKQLFVEQHKHYL<br>DEIIEQISEFSKRVILADANLDKVLSAYNKHRDKPIREQAENIIHLFTL<br>TNLGAPAAFKYFDTTIDRKRYTSTKEVLDATLIHQSITGLYETRIDLS<br>QLGGD]SGGSPKKKRKV |

The invention illustratively described herein may suitably be practiced in the absence of any element or elements, limitation or limitations, not specifically disclosed herein. Thus, for example, the terms “comprising”, “including”, “containing”, etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred examples and optional features, modification and variation of the inventions embodied therein herein disclosed may be resorted to by those skilled in the art, and that such modifications and variations are considered to be within the scope of this invention.

As used in this application, the singular form "a," "an," and "the" include plural references unless the context clearly dictates otherwise. For example, the term "a genetic marker" includes a plurality of genetic markers, including mixtures and combinations thereof.

As used herein, the term "about", in the context of concentrations of components of the formulations, typically means +/−5% of the stated value, more typically +/−4% of the stated value, more typically +/−3% of the stated value, more typically, +/−2% of the stated value, even more typically +/−1% of the stated value, and even more typically +/−0.5% of the stated value.

Throughout this disclosure, certain examples may be disclosed in a range format. It should be understood that the description in range format is merely for convenience and brevity and should not be construed as an inflexible limitation on the scope of the disclosed ranges. Accordingly, the description of a range should be considered to have specifically disclosed all the possible sub-ranges as well as individual numerical values within that range. For example, description of a range such as from 1 to 6 should be considered to have specifically disclosed sub-ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Certain examples may also be described broadly and generically herein. Each of the narrower species and subgeneric groupings falling within the generic disclosure also form part of the disclosure. This includes the generic description of the examples with a proviso or negative limitation removing any subject matter from the genus, regardless of whether or not the excised material is specifically recited herein.

Other examples are within the following claims and non-limiting examples. In addition, where features or aspects of the invention are described in terms of Markush groups, those skilled in the art will recognize that the invention is also thereby described in terms of any individual member or subgroup of members of the Markush group.

EXAMPLES

The CG to GC Base Editor (CGBE) disclosed in the present application leverage the cell's innate base excision repair (BER) pathway. Among the proteins involved in the BER pathway, the inventors of the present invention have extensively characterized three major players, which are DNA polymerase 13, DNA ligase III and XRCC1.

Because the relative orientation of Cas9 fusions may affect the activity of the fusion, several versions of the CGBE candidates with the fused rAPOBEC and BER proteins at different orientations with respect to nCas9 were tested (FIG. 1*b*). HEK293AAV cells were separately treated with each candidate along with gRNAs designed to target genomic sites HEK2 and HEK3, both of which were previously used to characterize base editors. As controls, BE3 and BE4 were used to treat the cells with the same gRNAs. Since no effective means of C:G to G:C base editing was known at the time, and BE3 has been observed to effect this reaction as a byproduct of C:G to T:A editing4, BE3 was used as a benchmark for the CGBEs.

High-throughput sequencing of the HEK2 site revealed that the CGBE candidates were able to edit C:G to both G:C and T:A. Out of the 31 candidates tested, 20 candidates showed an increased level of C:G to G:C editing relative to BE3 at position 6 within the protospacer (FIG. 4*a*). The next closest available C was at position 4, where editing levels were lower (<10%) (FIG. 4*b*), suggesting a narrower editing window than 13E31. In the best performing candidates, up to 29% C:G to G:C editing and 6% C:G to T:A editing were observed for the CGBE candidates, compared with 14% and 36% respectively for BE4, and 16% and 18% respectively for BE3.

Similarly, sequencing at the HEK3 site revealed editing of C:G to both G:C and T:A. 12 out of 31 candidates gave C:G to G:C editing levels at position 5 that were higher than that achieved by BE3, with the best performing candidates effecting up to 13% C:G to G:C editing compared with 4% for BE3 (FIG. 5*a*). Despite an increase in C:G to T:A editing with CGBEs compared to BE3, a more than twofold increase in C:G to G:C editing with CGBEs led to an increase in the editing ratio of C:G to G:C compared to C:G to T:A. Compared to position 5, C:G to G:C editing at position 3 and position 4 are significantly lower (FIGS. 5*b* and 5*c*). From this pilot screen, seven of the best performing candidates were shortlisted for a secondary screen (FIG. 1*c*).

Figure 6:
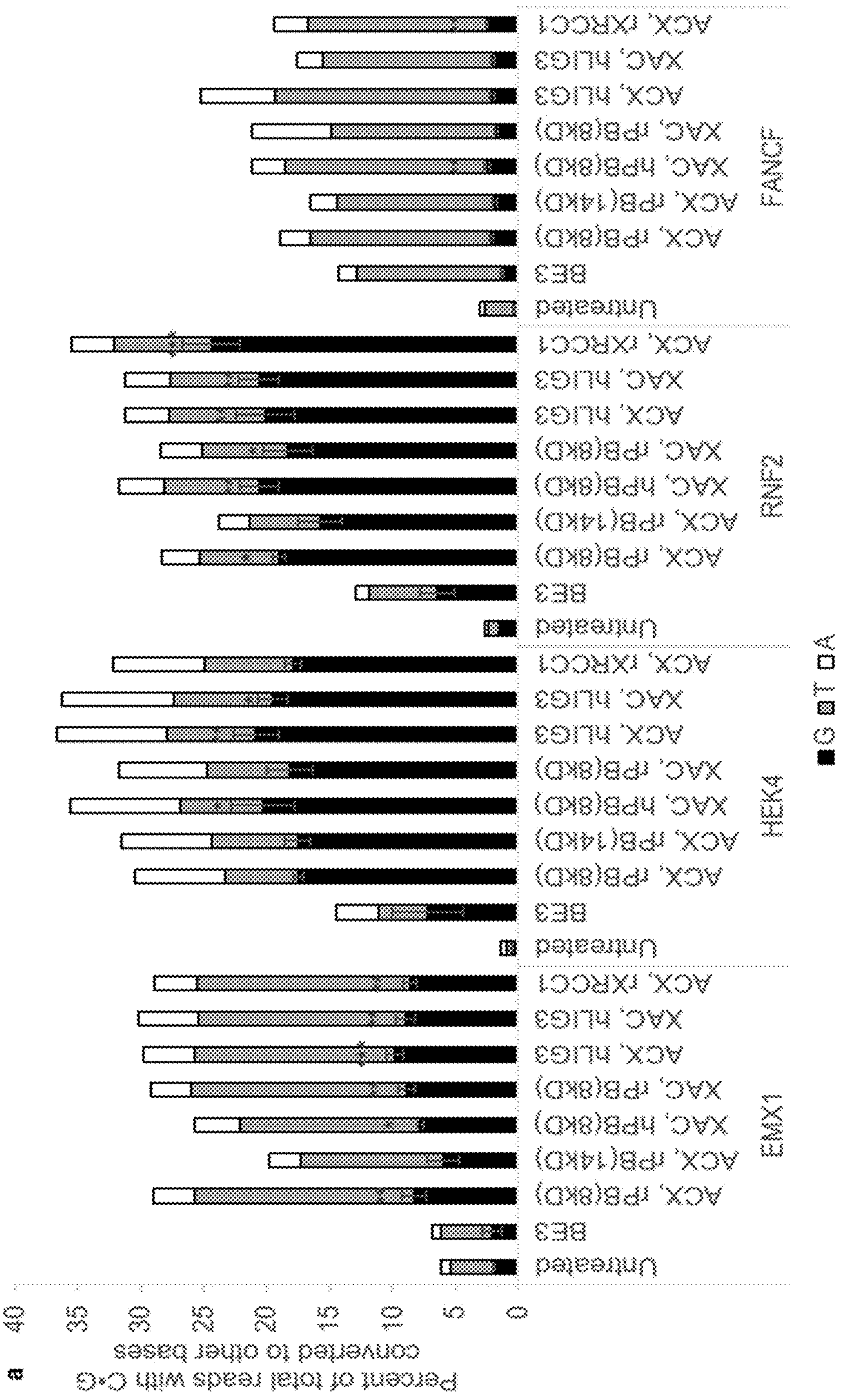
FIG. 6 shows 3 column graphs. (a) CGBE candidates effect C:G to G:C mutations at EMX1, HEK4, RNF2, and FANCF. C:G to G:C editing is the main edit at HEK4 and RNF2; C:G to T:A editing is the main edit at FANCF and EMX1. (one-way ANOVA against 'BE3,' Dunn-Šidák; n=3, mean±standard error) (b) CGBE editing at disease-associated genes ADRB2, GJB2, MYBPC3, and GAL 292. Note that ADRB2 contains naturally occurring polymorphism in HEK293AAV cells, and hence this data is not included in FIG. 3. (one-way ANOVA against 'Untreated,' Dunn-Šidák; n=5 for ADRB2 and MYBPC3; n=4 for GJB2; n=1 for GAL 292, mean±standard error) (c) Mean C:G to G:C editing as a percent of all reads across 16 NCN sites. CGBEs increase C:G to G:C editing by three to four fold compared to BE3, across all possible NCN sequences. gRNA sequences are included in Extended Data Table 2. *p<0.05; p<0.01; *p<0.001 (one-way ANOVA against 'BE3,' Dunn-Šidák; n=32, mean±standard error).
Figure 7:
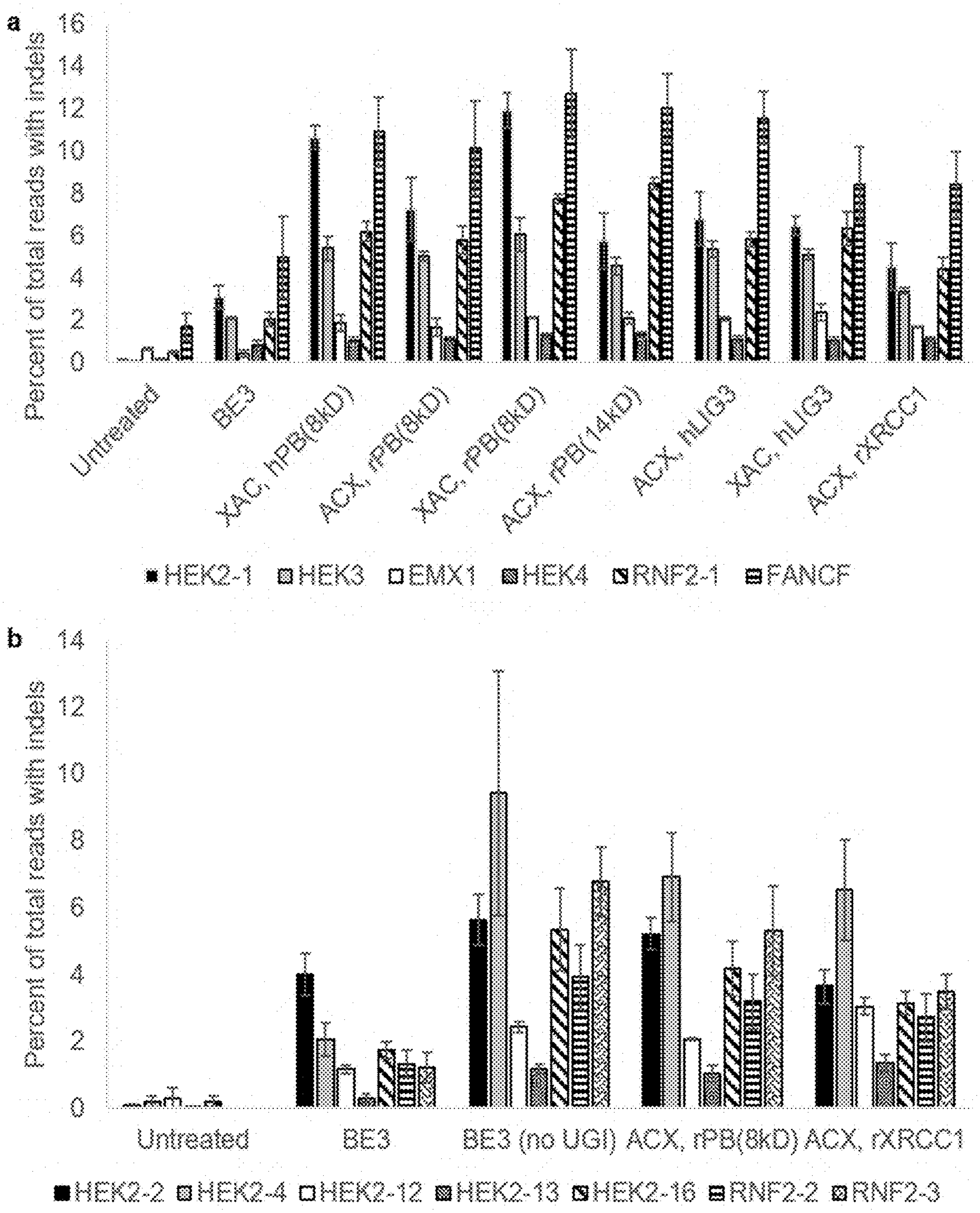
FIG. 7 shows 2 column graphs. (a) CGBE candidates generate higher indel rates than BE3. ACX, rXRCC1 has the lowest indel rate of CGBE candidates. (n=3, mean±standard error) (b) Removing UGI from BE3 increases indel rate; fusing BER proteins rPB(8 kD) or rXRCC1 decreases indel rate modestly. (n=3, mean±standard error) An additional set of gRNA:targets used here validates the conclusion from (a). While further mechanistic studies would be necessary, a possible hypothesis is that recruitment of the BER complex repairs abasic sites and the shortened persistence of these abasic sites may then lead to a lower propensity for indels.

CGBEs were further tested for C:G to G:C editing at four genomic sites known to be amenable to BE3-mediated editing—EMX1, HEK4, RNF2, and FANCF (FIG. 6*a*). With CGBEs, C:G to G:C edits were efficiently induced (17-24%, compared to 8-10% with BE3) as the predominant product (up to 69% purity) at HEK4 and RNF2. At sites EMX1 and FANCF, up to 9% C:G to G:C editing was observed despite this not being the predominant edit, while BE3 effected up to 3% C:G to G:C editing. Across the sites tested, CGBE candidates exhibit higher indel rates than BE3 (FIG. 7*a*). This could be due to the generation of an abasic site—which is essential for BER—may have led to higher indel rates. From this secondary screen, ACX, rXRCC1 and ACX, rPB(8 kD) are selected for further characterization.

Figure 2:
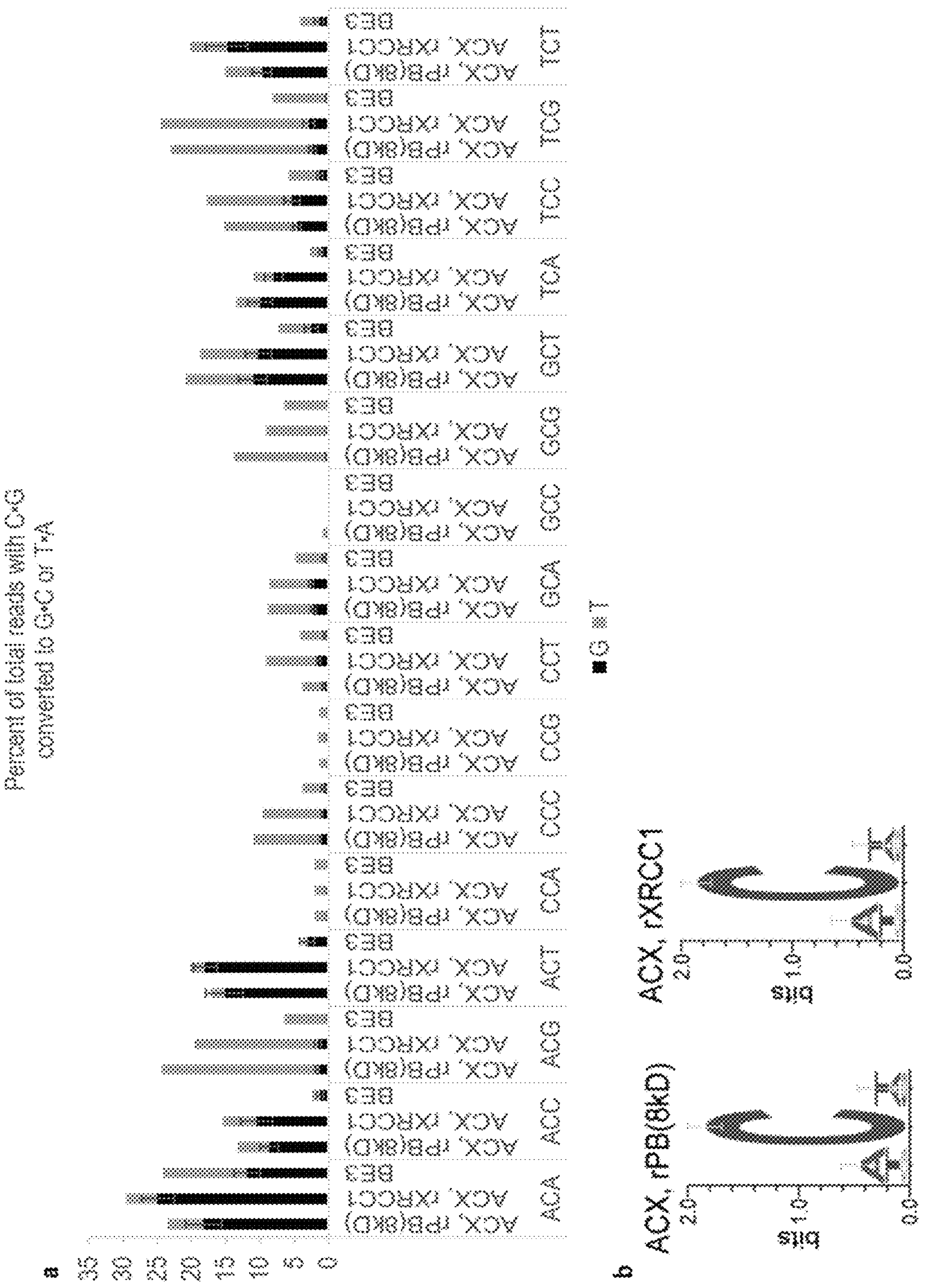
FIG. 2 shows 2 column graphs and 1 image showing the quantitative representation of the C:G to G:C editing. (a) Evaluation of C:G to G:C editing at each NCN DNA motif. 16 different gRNAs were designed to target the genomic region around the HEK2 site (HEK2-1 to HEK2-16 in Extended Data Table 2), chosen such that the gRNA-to-target combinations together cover all NCN motif contexts and that genomic distance among gRNAs are minimized (14/16 gRNAs, including the initial HEK2-1 gRNA:target, reside within a 1.8 kb region, while the other 2 gRNAs target within 10 kb). (n=2, mean±standard error). (b) DNA WebLogo created with target motifs in which C:G at position 6 was edited to G:C (n=2; error bars are Bayesian 95% confidence intervals). (c) Editing window of CGBEs using gRNAs with alternating 5'-W-C-3' motifs. Targeted C's are in a larger font. PAMs are underlined. *p<0.05; p<0.01 (one-way ANOVA against 'BE3,' Dunn-Šidák; n=3, mean±standard error).
Figure 2:
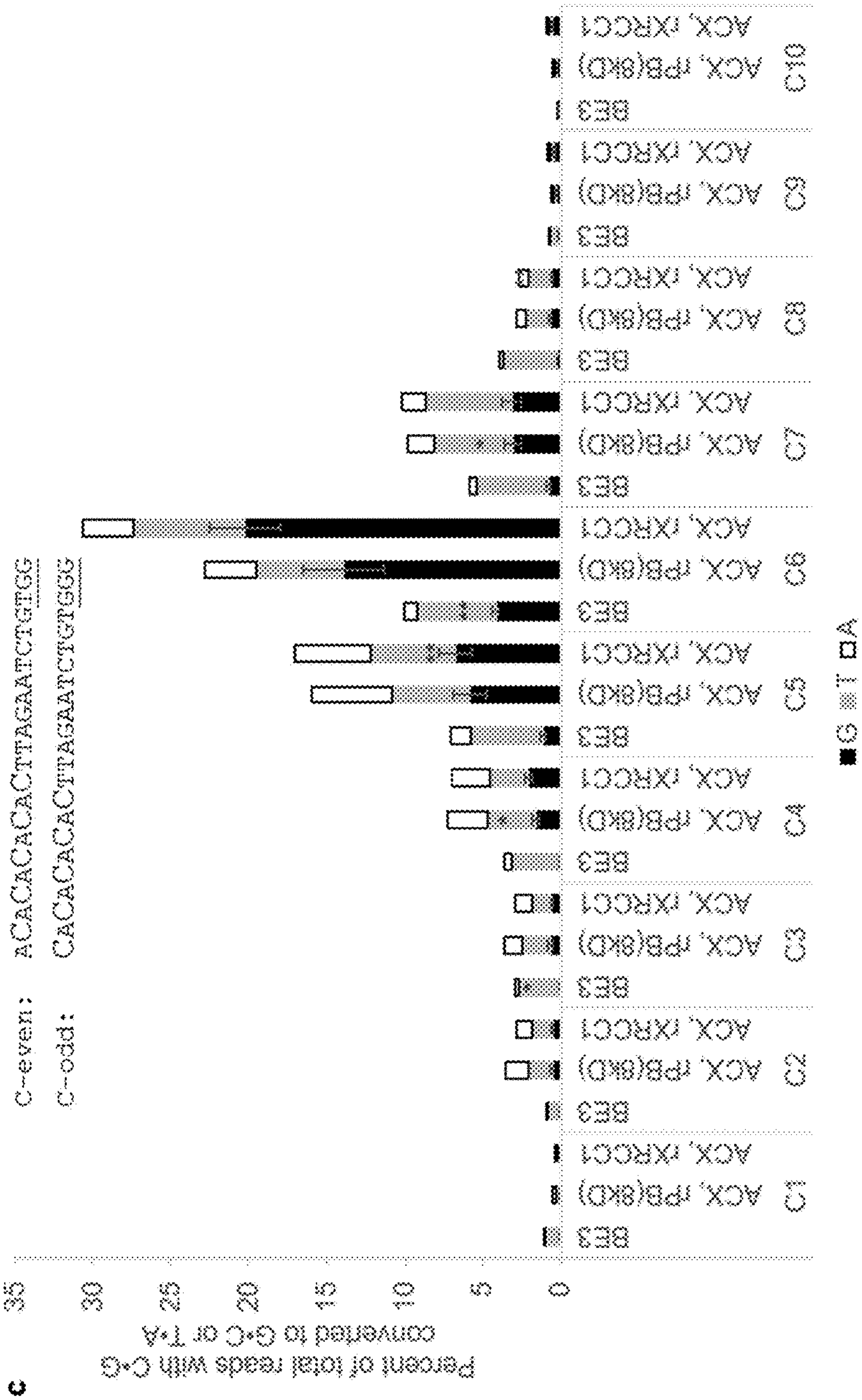

It is then determined if target sequence context impacts editing efficiency. In characterizing the two CGBEs with four gRNAs targeting four disease-associated sites—including dyslipidemia-associated gene ADRB2, hearing loss-associated gene GJB2, and hypertrophic cardiomyopathy-associated gene MYBPC3—it was observed that not only did CGBEs efficiently interrogate disease-associated genes, but they also gave higher levels of C:G to G:C editing at C's immediately following an A/T (FIGS. 6*b*, 8 and Table 2). The difference in editing efficiency between gRNAs might be due to the different motifs within which the targeted C is located (for example, ACA at HEK2, CCA at HEK3; targeted C is underlined). To address such potential differences, 16 gRNAs that targeted 16 different HEK2 sites were designed. These gRNA-site combinations collectively cover all possible NCN motifs with targeted C's at position 6 (FIGS. 2*a* and 6*c*). Sequencing revealed that the most readily edited motif was ACA, while the least edited motif was GCC. Up to 10% C:G to G:C editing was observed for ACA, ACC, ACT, GCT, TCA, and TCT. This observation applied to both ACX, rPB(8 kD) and ACX, rXRCC1. From these results, it was proposed that the favored DNA motifs are WCW, ACC, and GCT (W is either A or T) (FIG. 2*b*). This understanding is consistent with the observation that C:G to G:C editing is more efficient at HEK2, HEK4, and RNF2, which all had favored DNA motifs of ACA, ACT, and TCT, whereas EMX1, FANCF, and HEK3, with suboptimal DNA motifs of TCC and CCA, are less amenable to C:G to G:C editing. With a preference for WCW, ACC, and GCT, the CGBEs as disclosed herein most efficiently target 6 out of 16 possible motifs.

Figure 4:
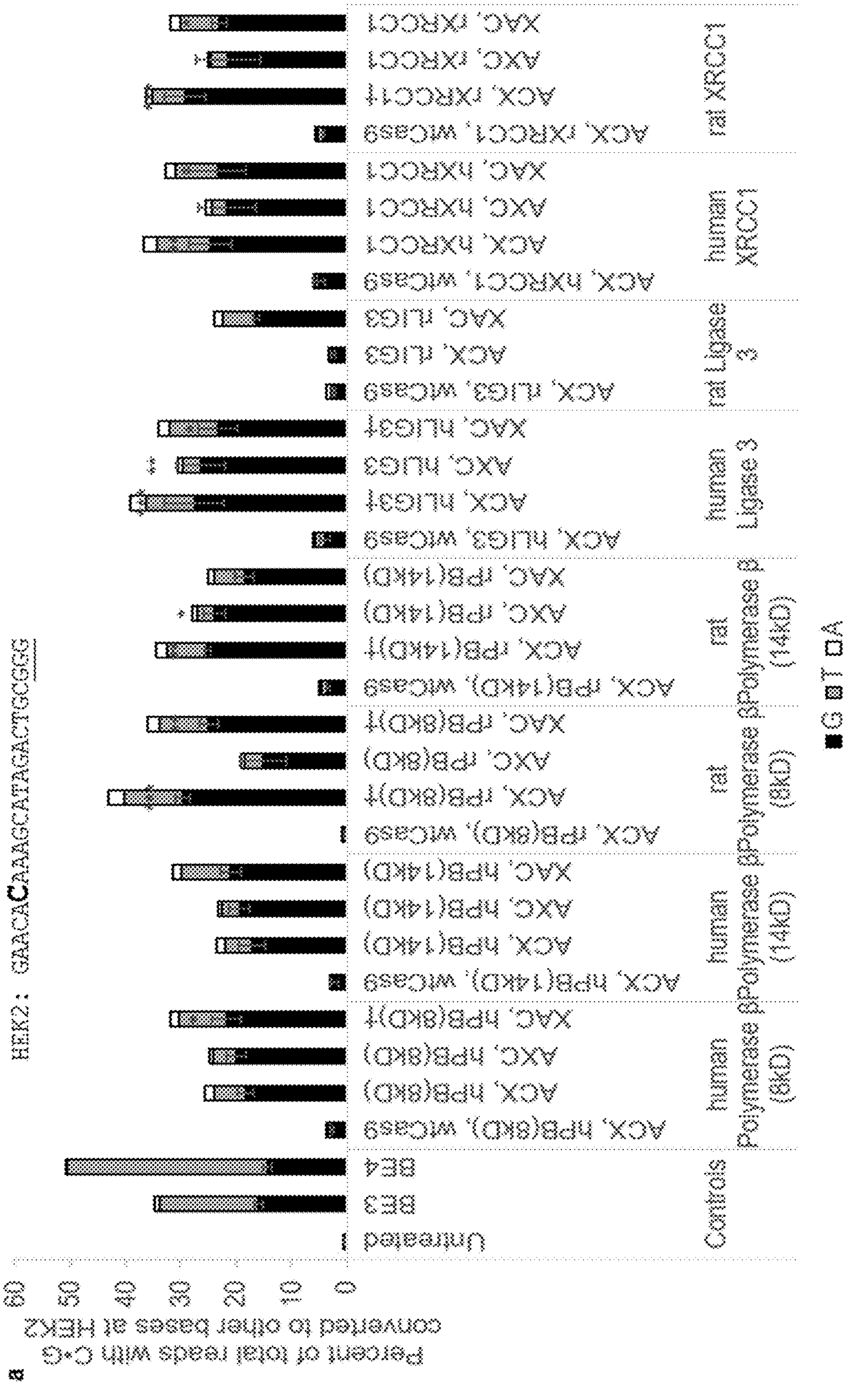
FIG. 4 shows 2 column graphs. (a) For some CGBE candidates, C:G to G:C editing is the predominant edit at position 6. (b) C:G to T:A editing is the predominant edit at position 4. The seven candidates selected for further studies are marked with †. Targeted C's are in in a larger font. PAMs are underlined. *p<0.05; p<0.01; *p<0.001 (one-way ANOVA against 'Untreated,' Dunn-Sidak; n=3, mean±standard error).
Figure 4:
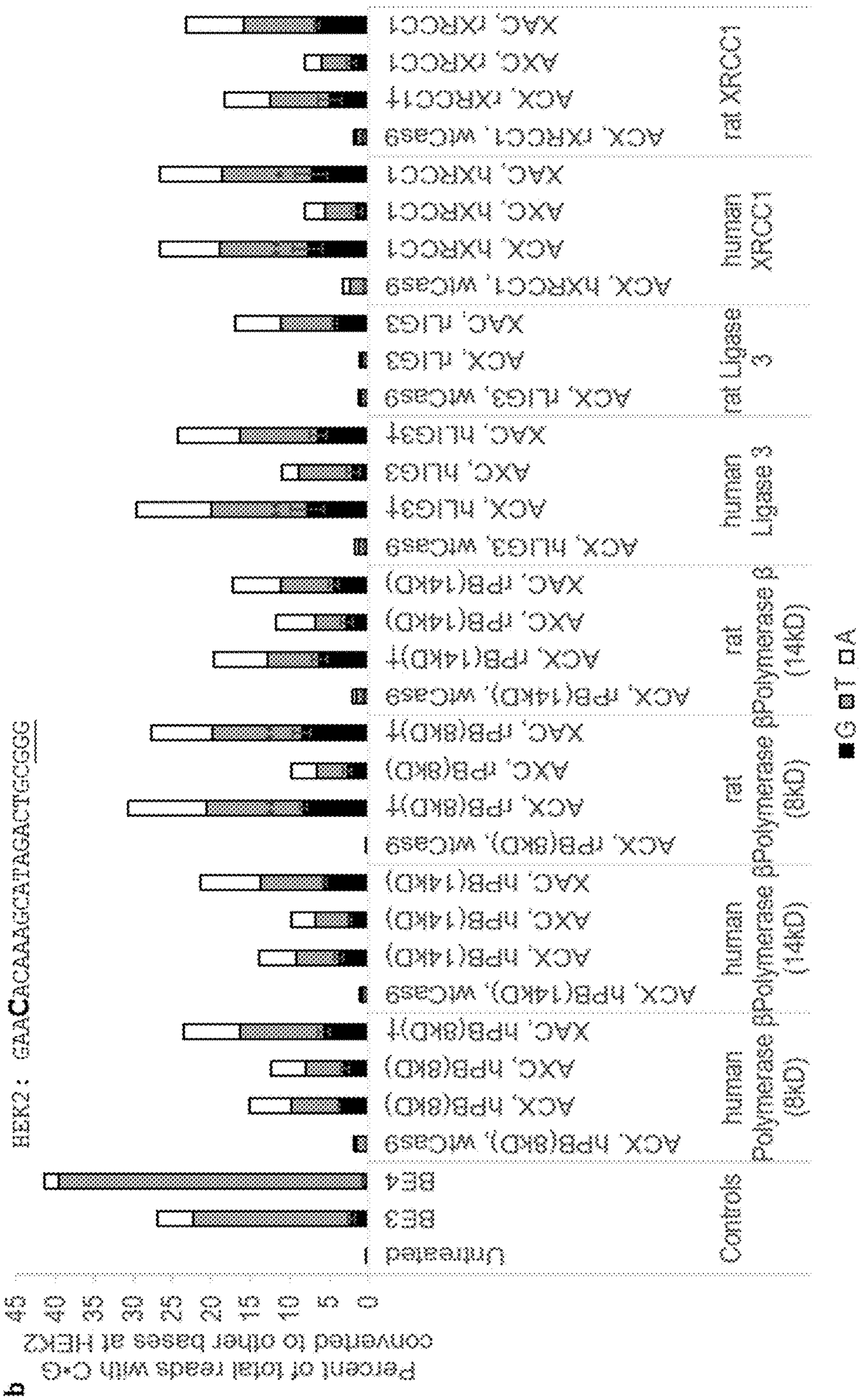
Figure 5:
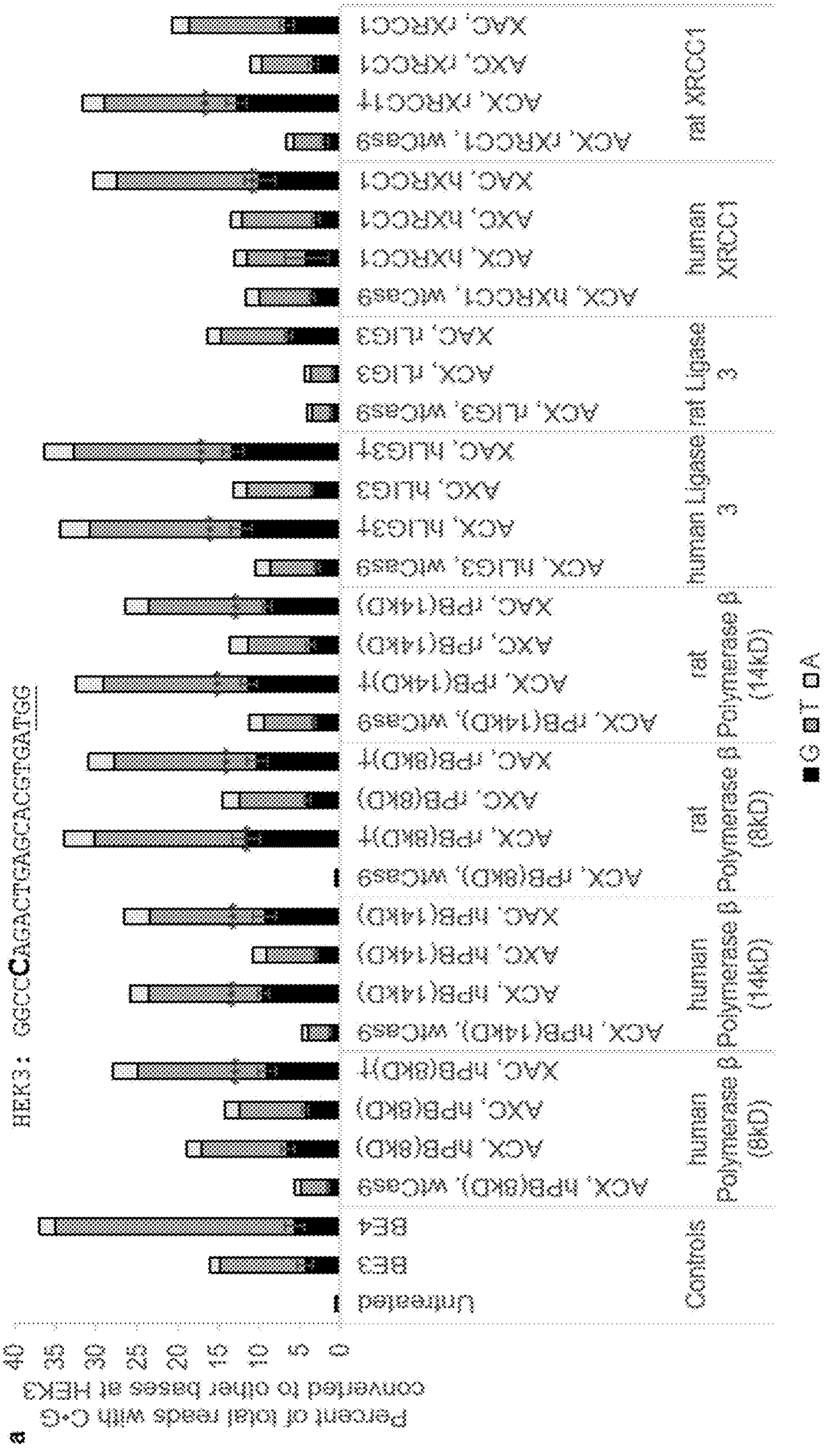
FIG. 5 shows 3 column graphs representing the initial screen of CGBE candidates on HEK3 at (a) position 5, (b) position 4, and (c) position 3. The seven candidates selected for further studies are marked with †. Targeted C is in a larger font. PAM is underlined. *p<0.05; p<0.01; *p<0.001 (one-way ANOVA against 'Untreated,' Dunn-Šidák; n=3, mean±standard error).
Figure 5:
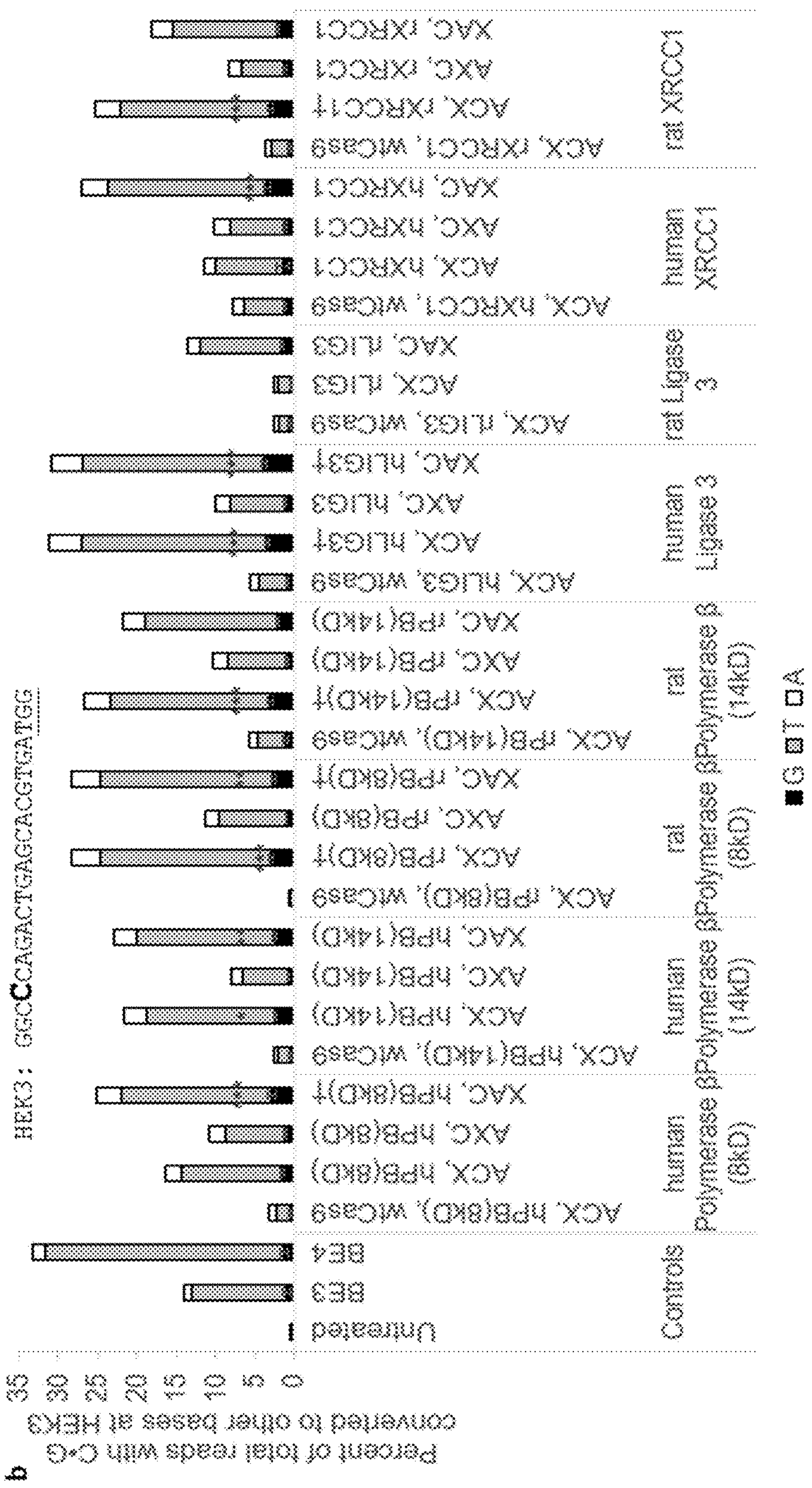
Figure 5:
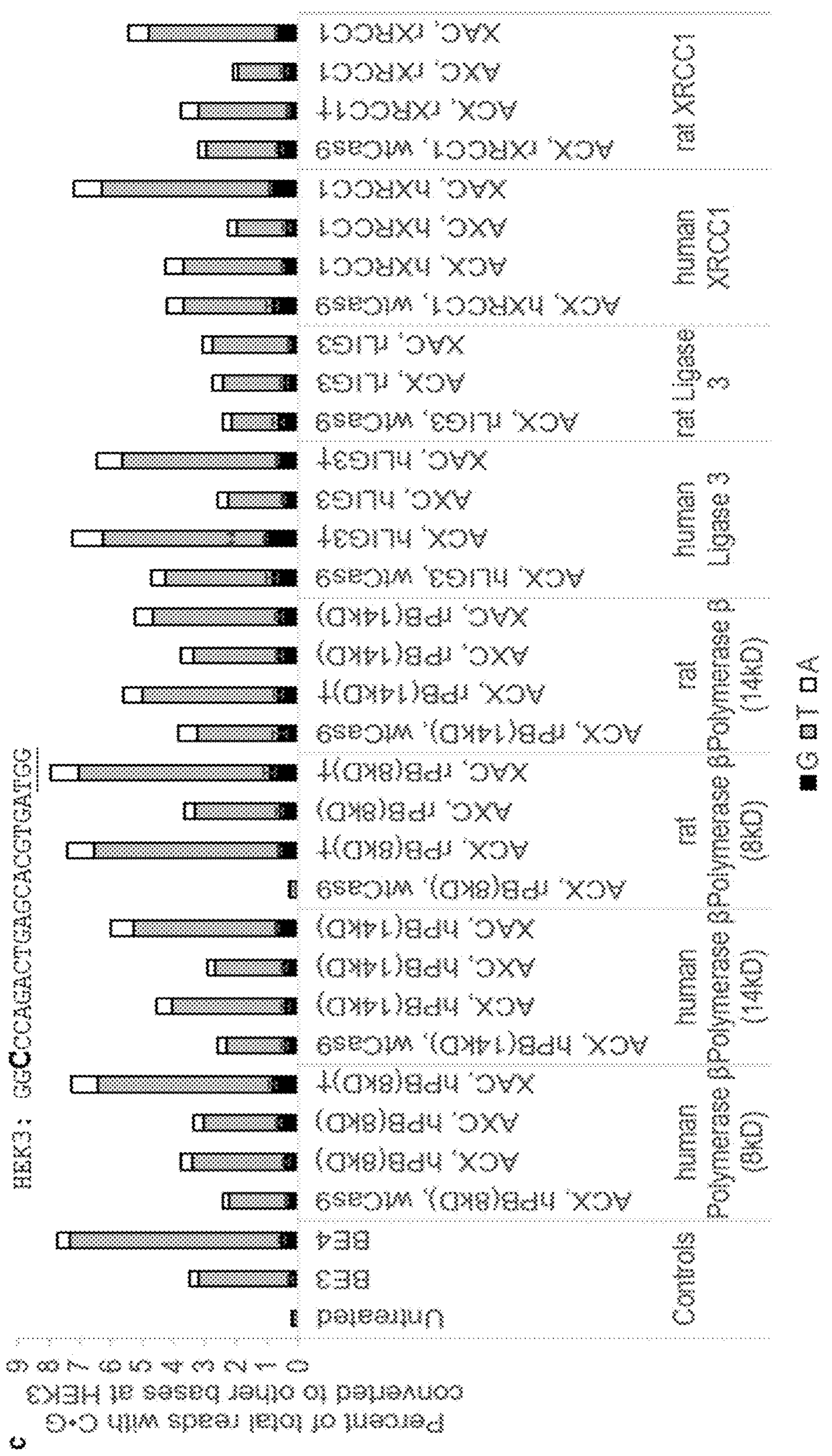

A reduction in editing levels at position 4 relative to position 6 of HEK2 was observed (FIG. 4). Similarly, editing levels at position 3 and position 4 of HEK3 are lower than that at position 5 (FIG. 5). Both observations suggested that the candidates might not inherit the exact base editing window of BE3. To elucidate the editing window of the CGBEs, a genomic site that has an alternating 5'-W-C-W-C-W-C-3' sequence was chosen such that gRNAs can be designed with C's located either at every odd position or at every even position (FIG. 2*c*). BE3 C:G to T:A editing rates were assessed between positions 1 and 9, wherein higher editing efficiency was found between positions 4 and 8. For both ACX, rPB(8 kD) and ACX, rXRCC1, C:G to G:C editing was observed in a nine nucleotide window from positions 2 to 10. However, only at positions 5 and 6 was C:G to G:C editing the predominant and appreciable outcome.

Figure 3:
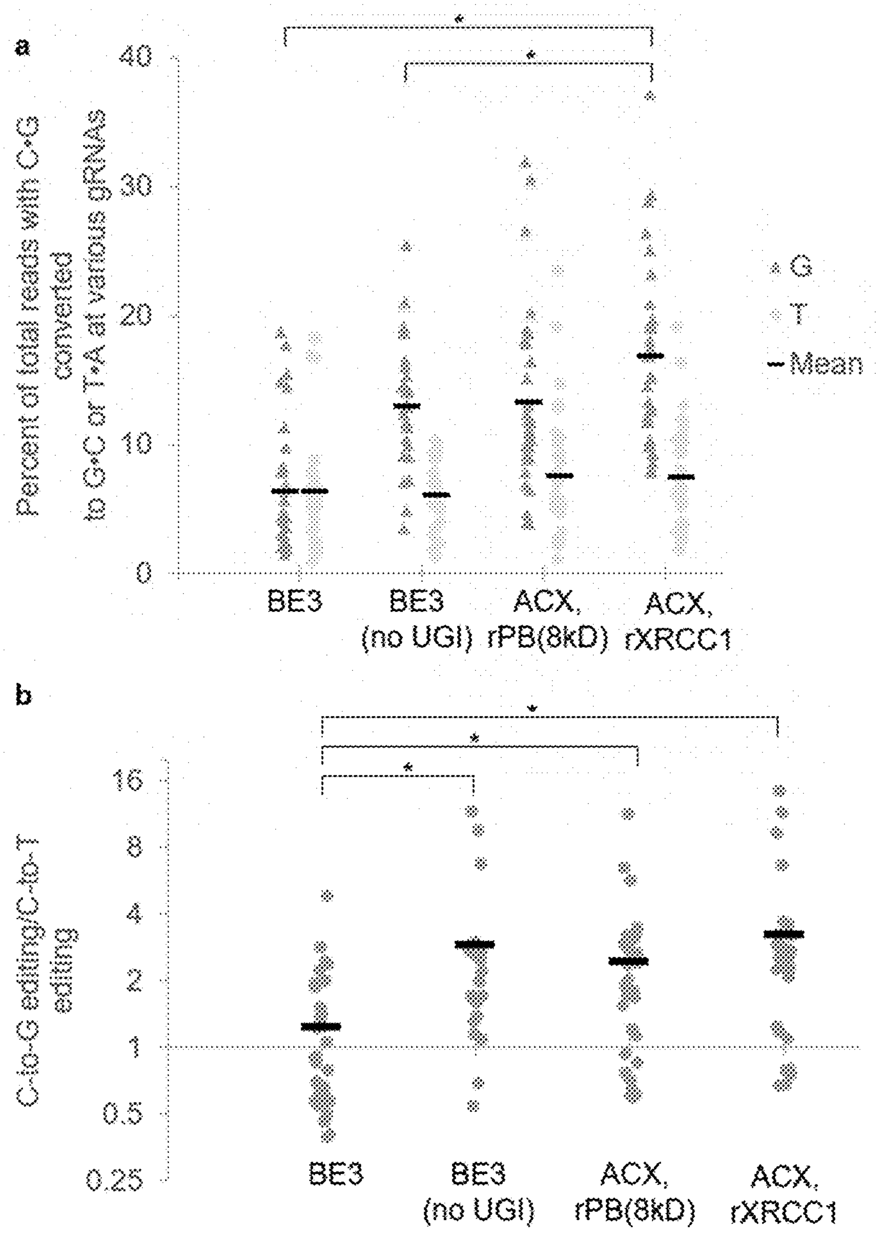
FIG. 3 shows 2 scatter plots. (a) Removal of UGI from BE3 increases C:G to G:C editing (triangles); fusion of rXRCC1 further increases C:G to G:C editing. The major byproduct is C:G to T:A editing (circles). (b) Mean C:G to G:C editing/C:G to T:A editing ratio. Data includes all biological replicates across 16 genomic loci that reside within a WCW, ACC or GCT motif. *p<0.05; ***p<0.001 (two-tailed Student's T test; n=28-45 biological replicates).
Figure 9:
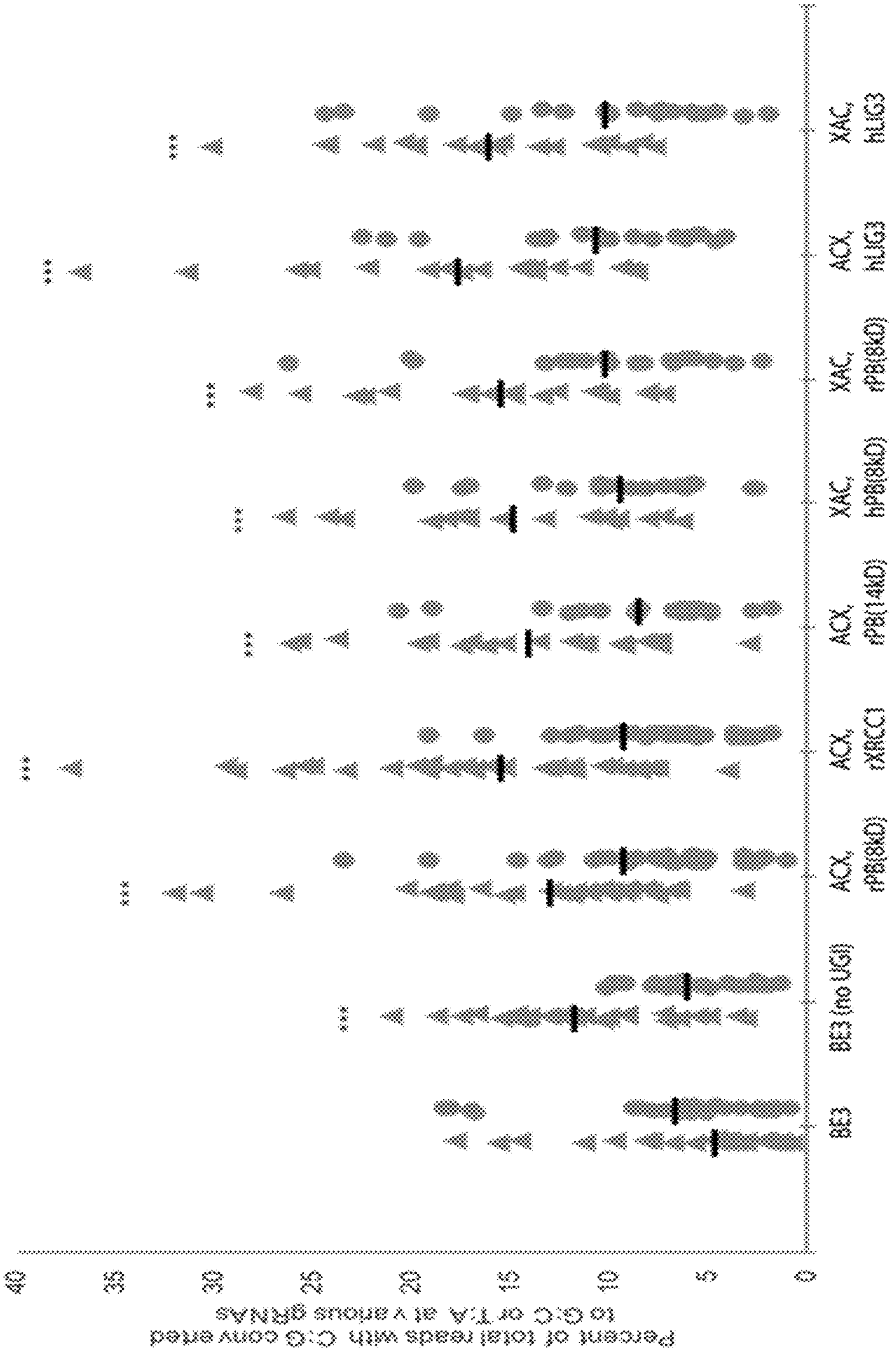
FIG. 9 shows 2 scatter plots. (a) C:G to G:C editing (blue triangles) vs. C:G to T:A editing (orange circles) as percent of all reads across gRNAs used in this study. All biological replicates are included except those targeting the 10 suboptimal C:G to G:C base editing motifs (FIG. 2*a* and FIG. 2*b*) and ADRB2 due to naturally occurring polymorphism (Extended Data FIG. 3*b*). (b) Ratio of C:G to G:C editing to C:G to T:A editing across gRNAs used in this study. Only BE3 (no UGI) and ACX, rXRCC1 give a significantly higher ratio of C:G to G:C editing/C:G to T:A editing. *p<0.05; p<0.01; *p<0.001 (one-way ANOVA against 'BE3,' Dunn-Šidák, n=20-45 biological replicates).
Figure 9:
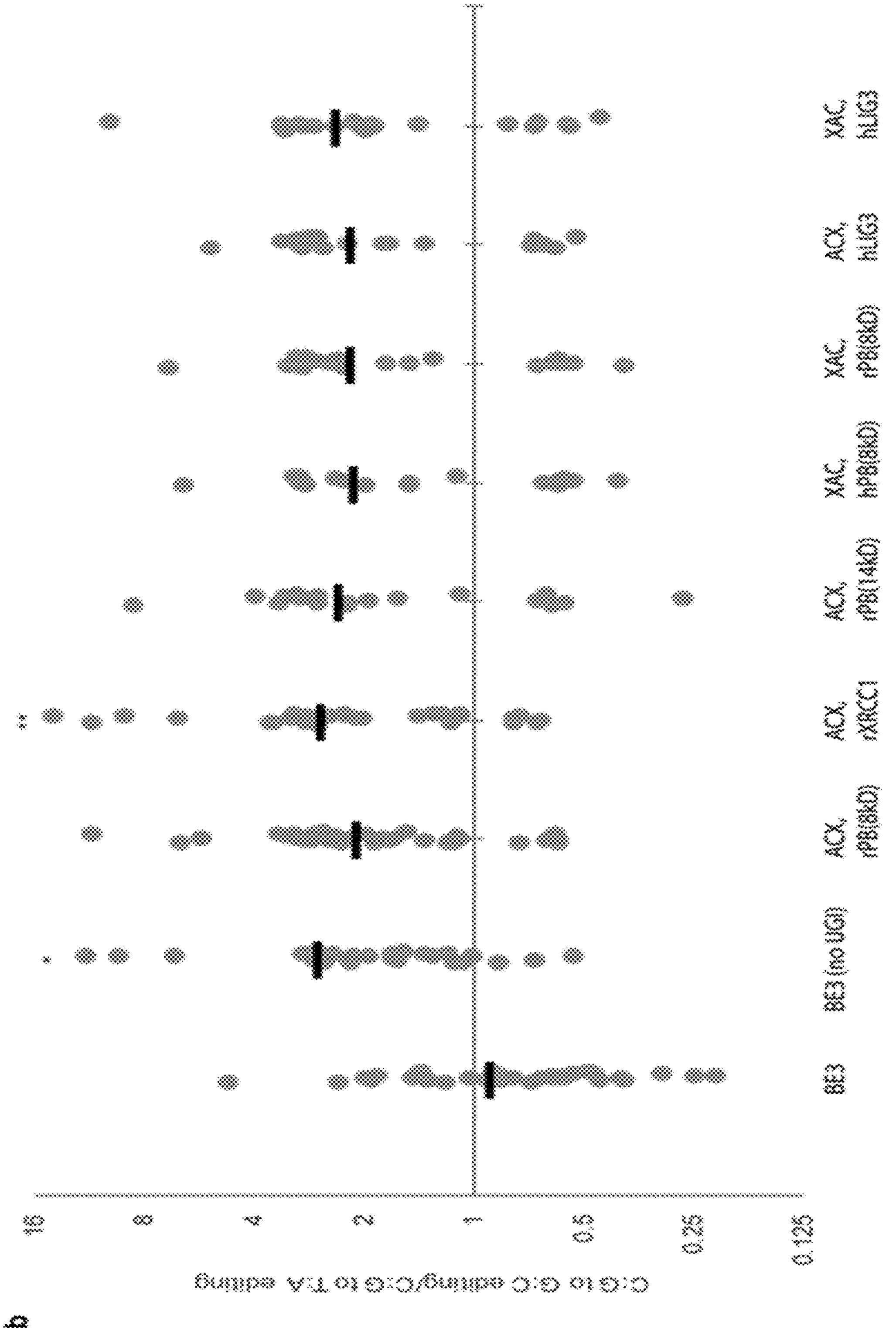

Recognizing that simply removing UGI can potentially increase C:G to G:C editing at the expense of C:G to T:A editing, the effect of fusing rXRCC1 or rPB(8 kD) to rAPOBEC-nCas9 was hence quantified. Across 28 independent treatments using a variety of gRNAs (FIGS. 3 and 9), BE3 was s to effect on average 4.4% C:G to G:C editing. Removing UGI from BE3 raised mean C:G to G:C editing to 11.5% but increased undesired indel byproducts to 5.0% (FIG. 7*b*). Fusing rPB(8 kD) did not provide additional significant effect ($p>0.05$). However, fusing rXRCC1 further raised mean C:G to G:C editing levels to 15.4% ($p=0.01$) and decreased undesired indel rates (3.4%), potentially due to an equilibrium shift from abasic site to repaired base. Meanwhile, the major byproduct C:G to T:A editing stayed between 6% and 9%. The results indicate that UGI removal from BE3 promotes C:G to G:C editing but increases byproducts; rXRCC1 fusion further increases C:G to G:C editing and decreases byproducts. Therefore, rAPOBEC-nCas9-rXRCC1 was identified as a preferred CGBE embodiment that effects C:G to G:C editing at 15.4±7% efficiency in human cells, at a 68±14% purity, within a three-nucleotide target window and WCW, ACC, and GCT target sequence contexts.

Figure 10:
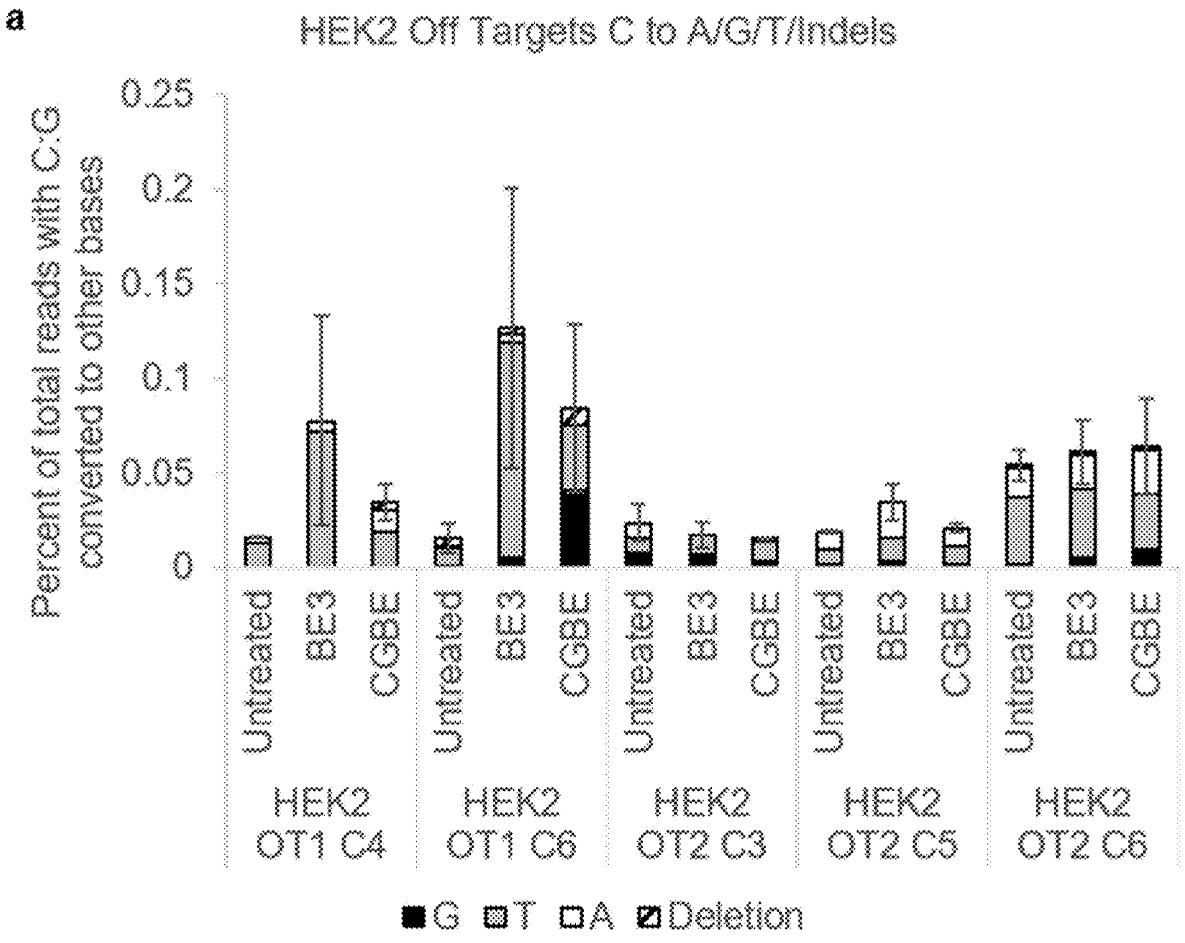
FIG. 10 shows 5 column graphs that illustrates the CGBE and BE3 off target activity at identified off-target sites with (a) HEK2-1 gRNA; (b) HEK3 gRNA; (c) HEK4 gRNA; (d) EMX1; and (e) FANCF. A total of 29 identified off-target sites with 68 editable C's using 5 gRNAs were tested. HEK3 and EMX1 off-target sites are Cas9 off-target sites identified via GUIDE-Seq19; HEK2, HEK4, and FANCF off-target sites are BE3 (no UGI) off-target sites identified via Digenome-Seq14. CGBE and BE3 induced >0.1% C:G to D:H edits at the same 15 off-target sites. At 2 out of these 15 positions, CGBE induced greater off-target editing frequency than BE3; at the remaining 13 sites, CGBE induced lower off-target editing frequency. 'OT5' indicates off-target 5; '04' indicates a 'C' at position 4. (n=2, mean±standard error).
Figure 10:
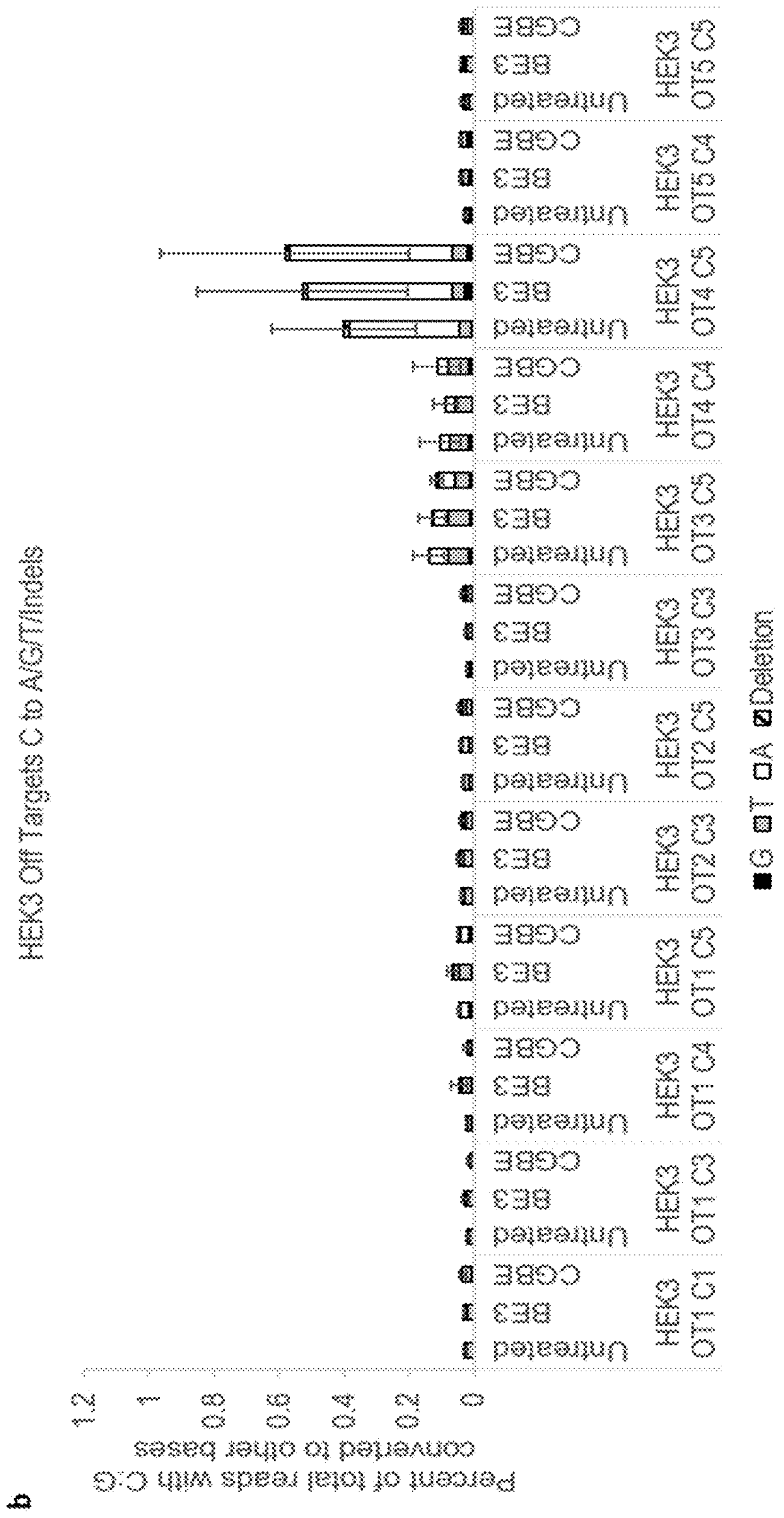
Figure 10:
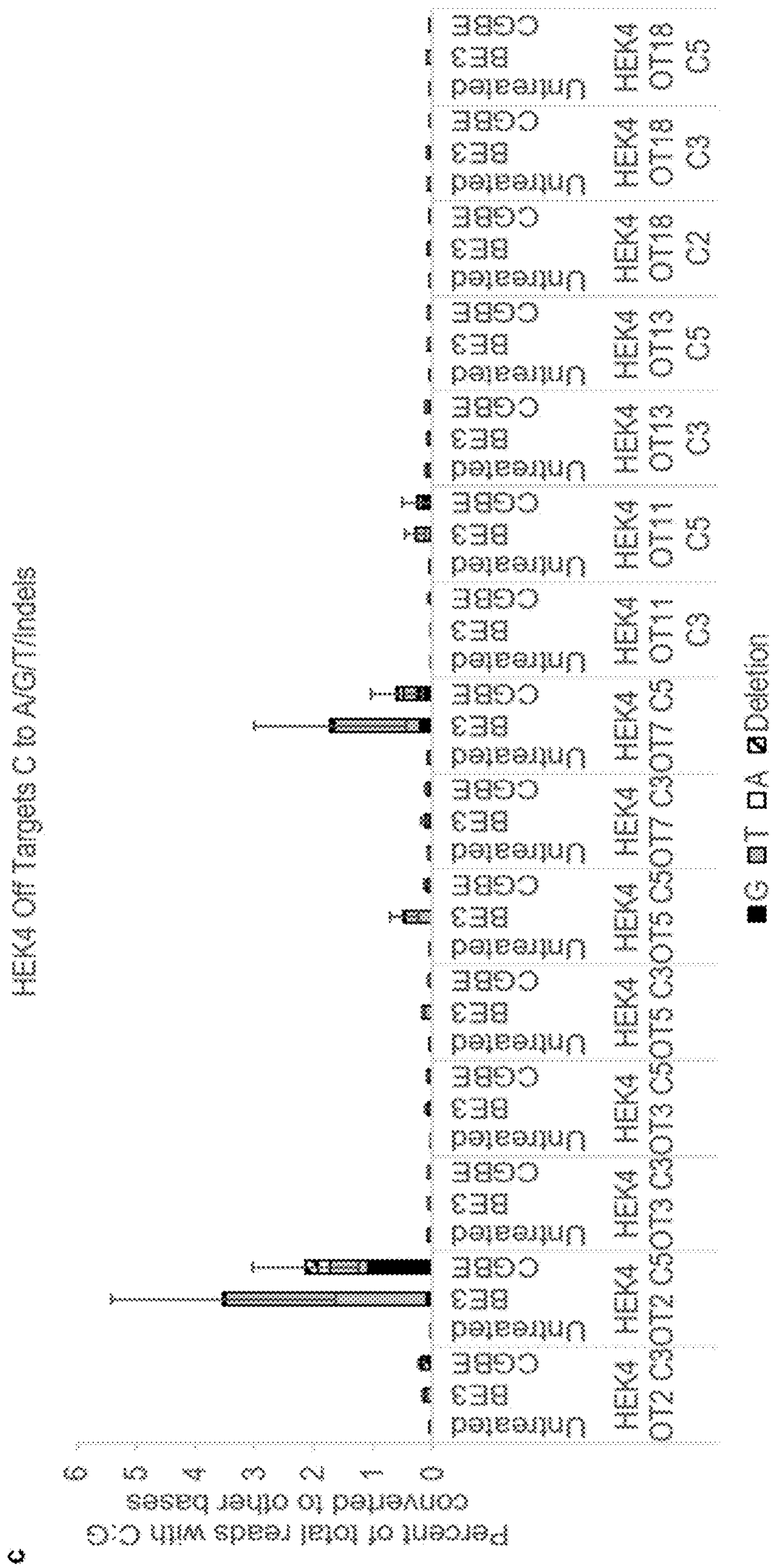
Figure 10:
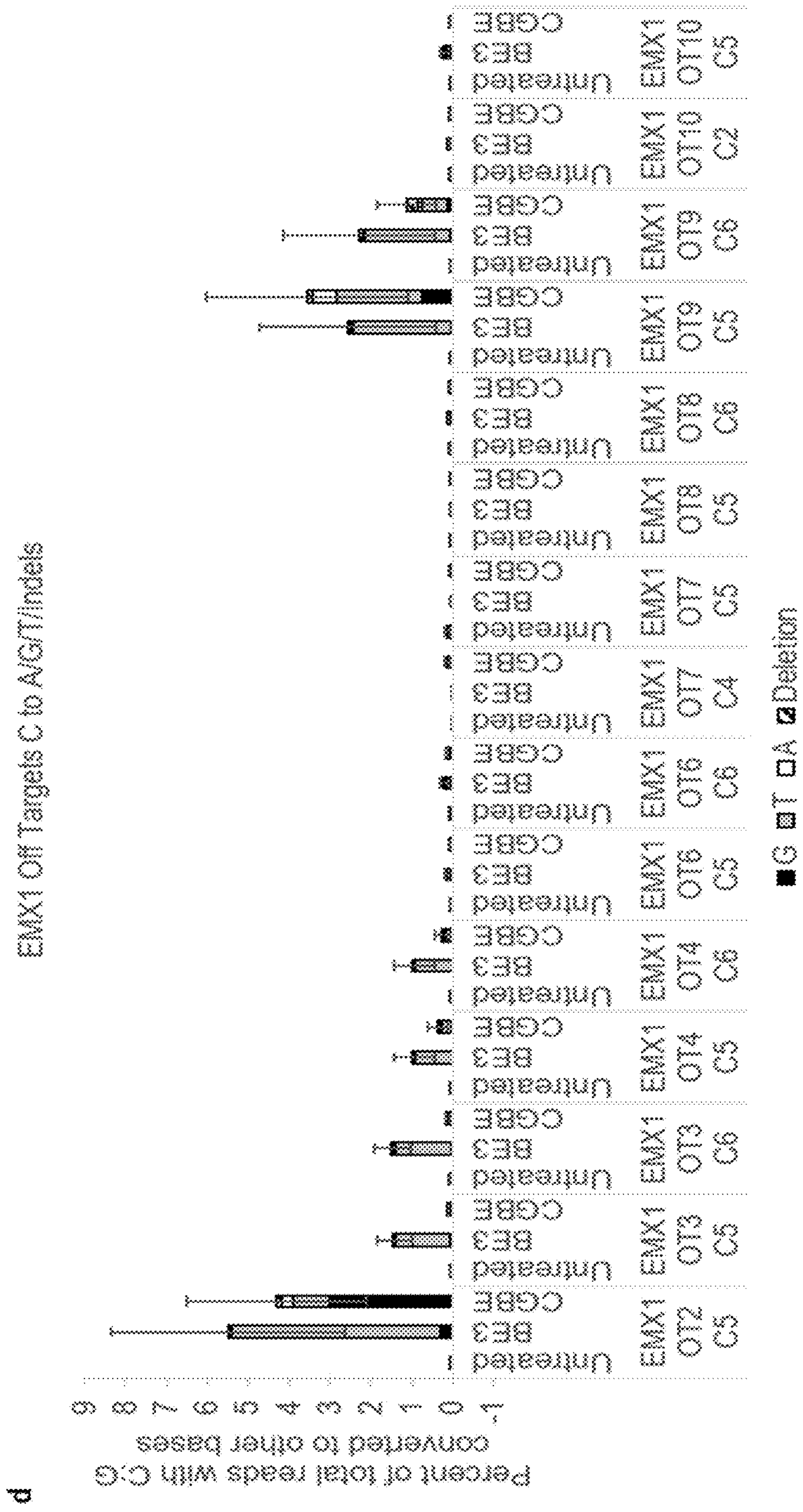
Figure 10:
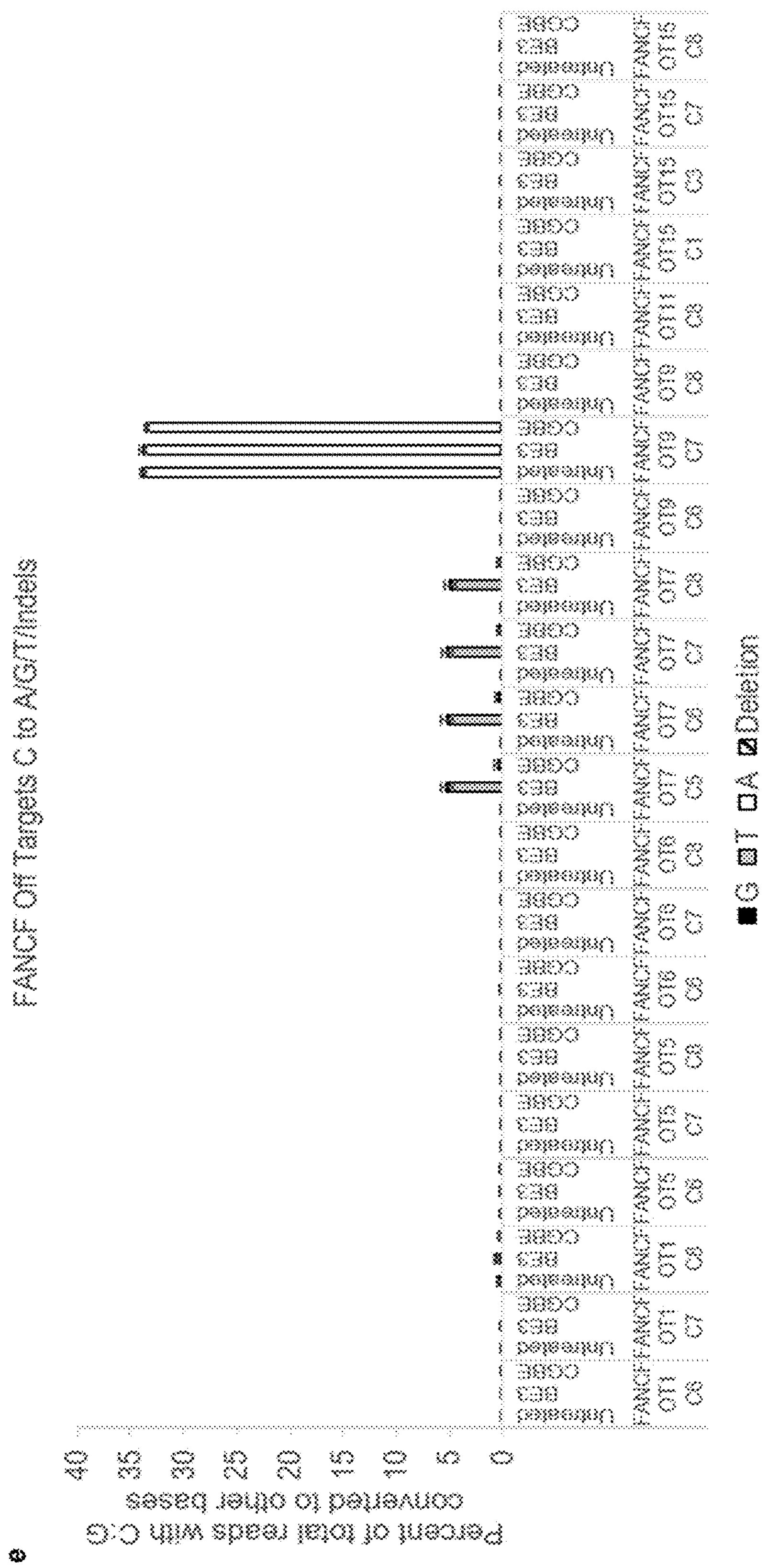

As with CRISPR-Cas systems, base editors have been reported to exhibit potential DNA and RNA off-target effects. Because CGBEs share the same APOBEC-nCas9 component with BE3, CGBE and BE3 activities were assessed side-by-side on 29 off-target sites using 5 gRNAs. CGBE and BE3 induced Ai % C:G to D:H edits at the same 15 positions (D is either A, G or T; H is either A, C, or T). Only at 2 out of these 15 positions did CGBE induce greater off-target editing than BE3; at the remaining 13 sites, CGBE showed lower off-target activity. While reduction of off-target activity can be attributed to lower C:G to T:A editing at off-target sites, C:G to G:C editing at the same off-target sites increased (FIG. 10). No site was found where CGBE induced off-target editing but BE3 did not. These results indicate that CGBE exhibits lower off-target activity at the off-target sites identified for Cas9 and for the BE3 architecture. Nevertheless, there are potentially vast sequence-independent DNA and RNA off-target effects that would require a detailed dissection in further work before direct translation of CGBEs.

Figure 14:
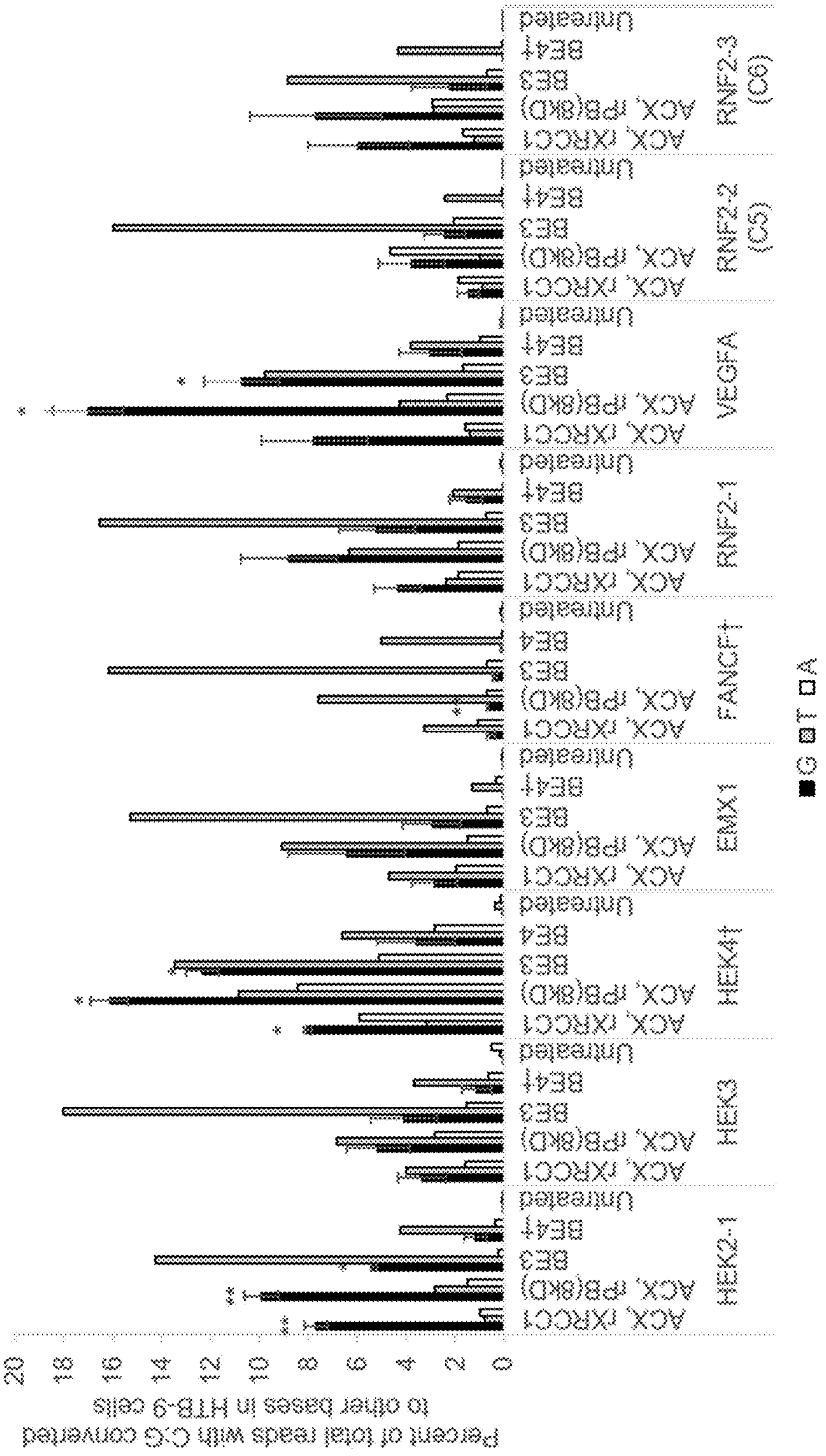
FIG. 14 shows 1 column graph that illustrates C:G editing in HTB-9 cells using various gRNA:target site pairs. (n=2 error bars denote standard error). CGBEs are able to efficiently induce C:G to G:C edits at HEK2-1, HEK4, RNF2-1, and VEGFA. Additionally, C6 editing (RNF2-3) appears to be higher than C5 editing (RNF2-2). Collectively, the data indicate that the editing preferences of CGBEs in HEK cells carry over to HTB9 cells. However, the more efficient CGBE in HTB9 cells is ACX, rPB(8 kD). *p<0.05; p<0.01 (two tailed Student's T-test against 'Untreated,' n=2, mean±standard error).
Figure 15:
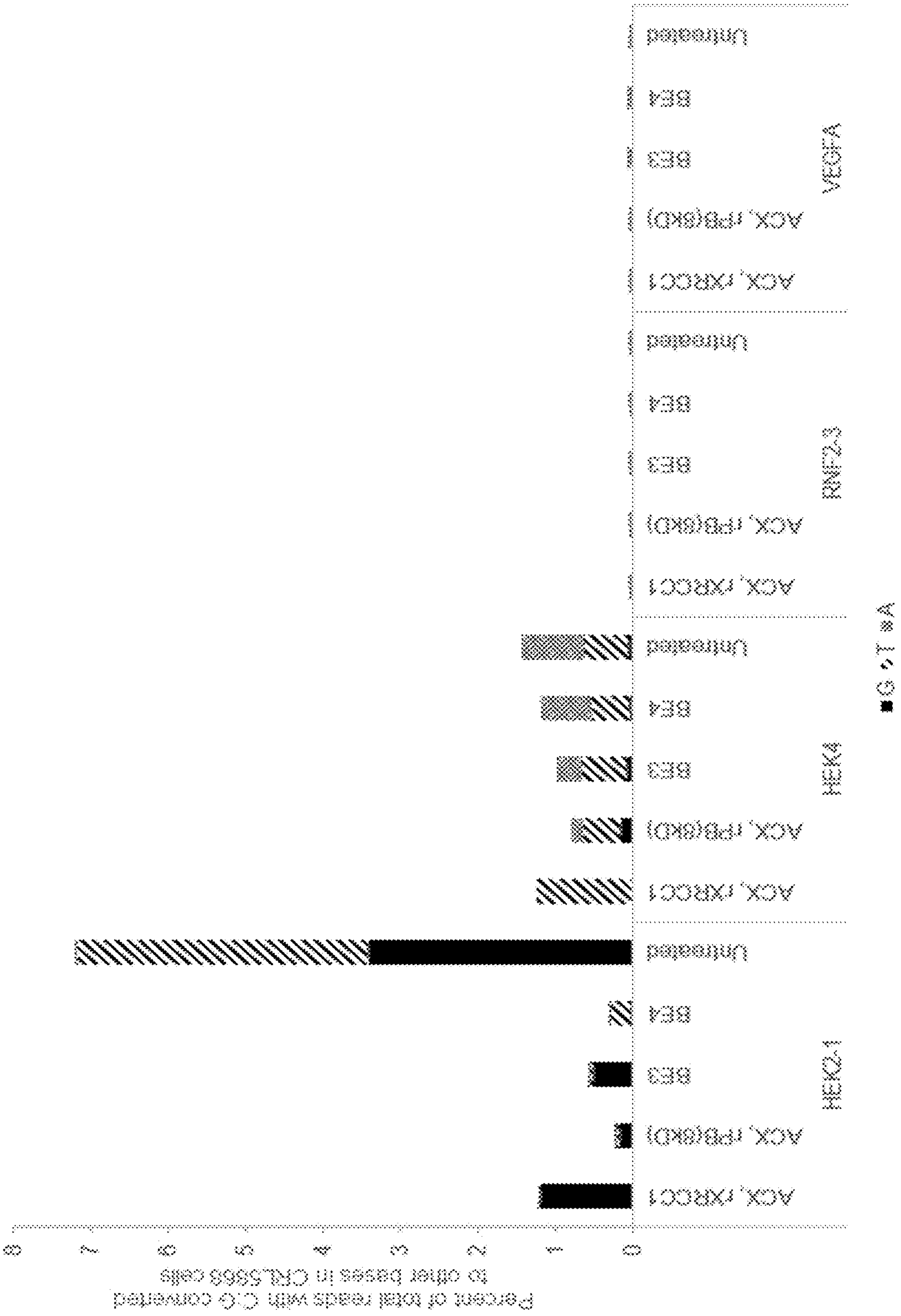
FIG. 15 shows 1 column graph that illustrates C:G editing in CRL5868 cells using various gRNA:target site pairs (n=1). These cells were transfected via nucleofection.
Figure 16:
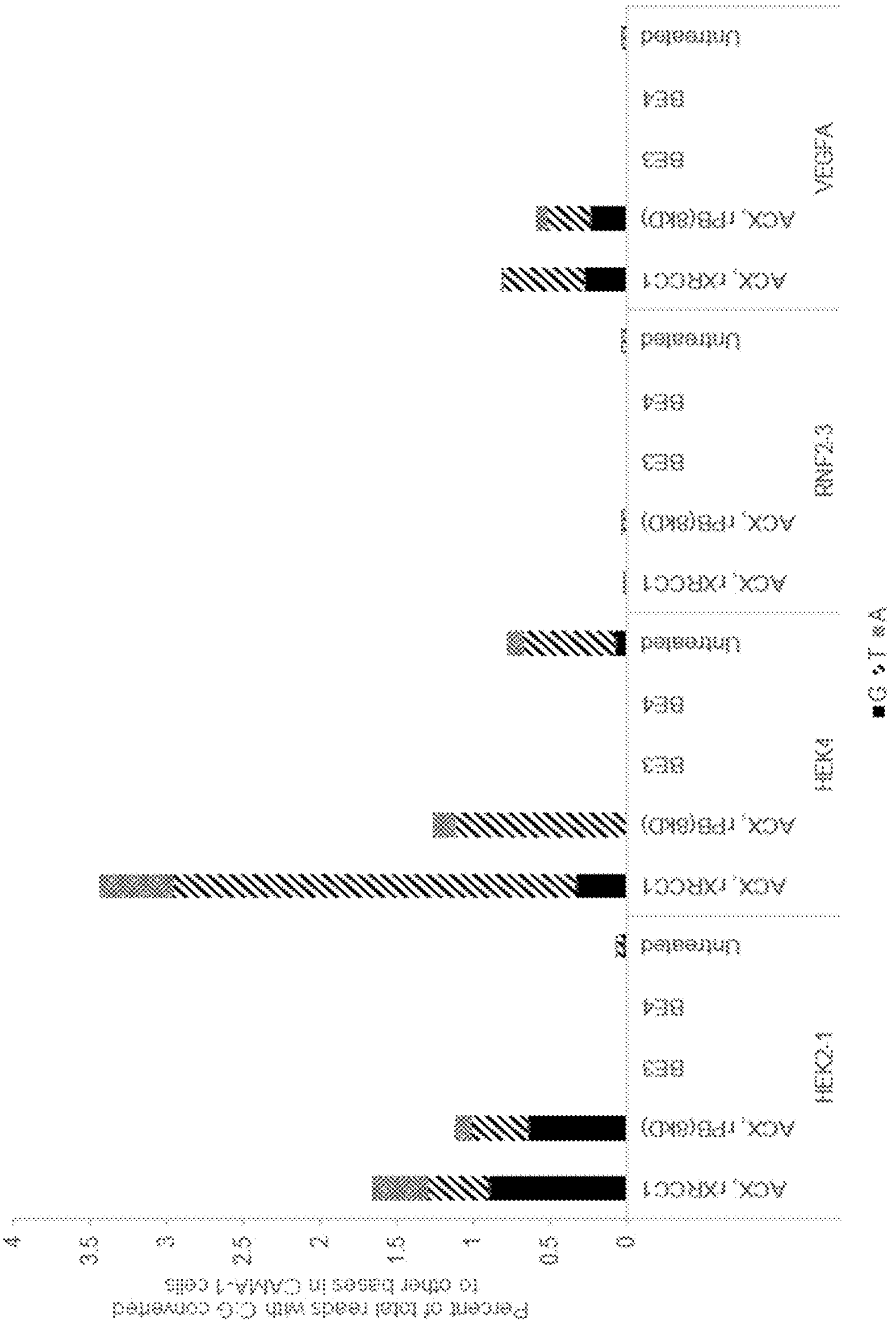
FIG. 16 shows 1 column graph that illustrates C:G editing in CAMA-1 cells using various gRNA:target site pairs (n=1). These cells were transfected via nucleofection.
Figure 17:
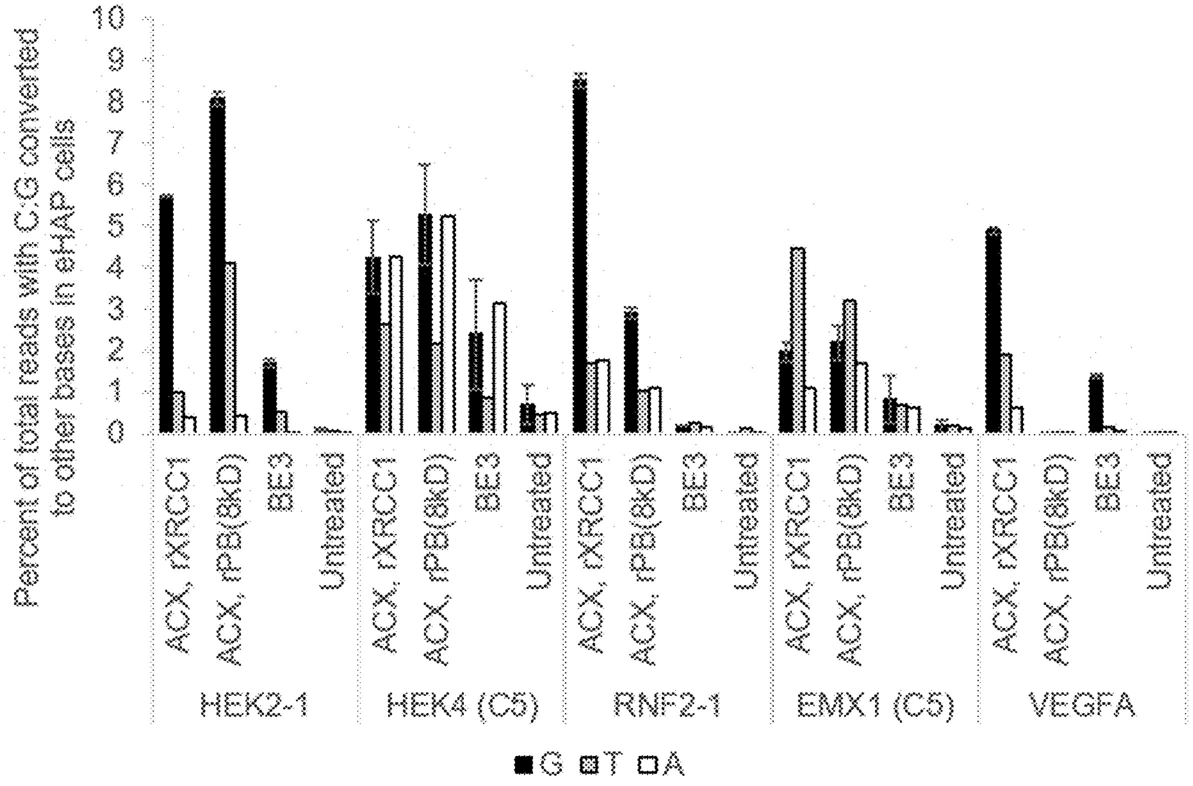
FIG. 17 shows 1 column graph that illustrates C:G editing eHAP cells using various gRNA:target site pairs (n=3). Although BE3 editing is low, we observed moderate levels of editing with both CGBEs. These results suggest that CGBE may be able to induce some C:G to G:C edits in certain circumstances under which similar base editing technology—like BE3—may not be as efficient (C:G to T:A edits; light blue). *p<0.05; p<0.01; *p<0.001 (two tailed Student's T-test against 'Untreated,' n=3, mean±standard error).
Figure 18:
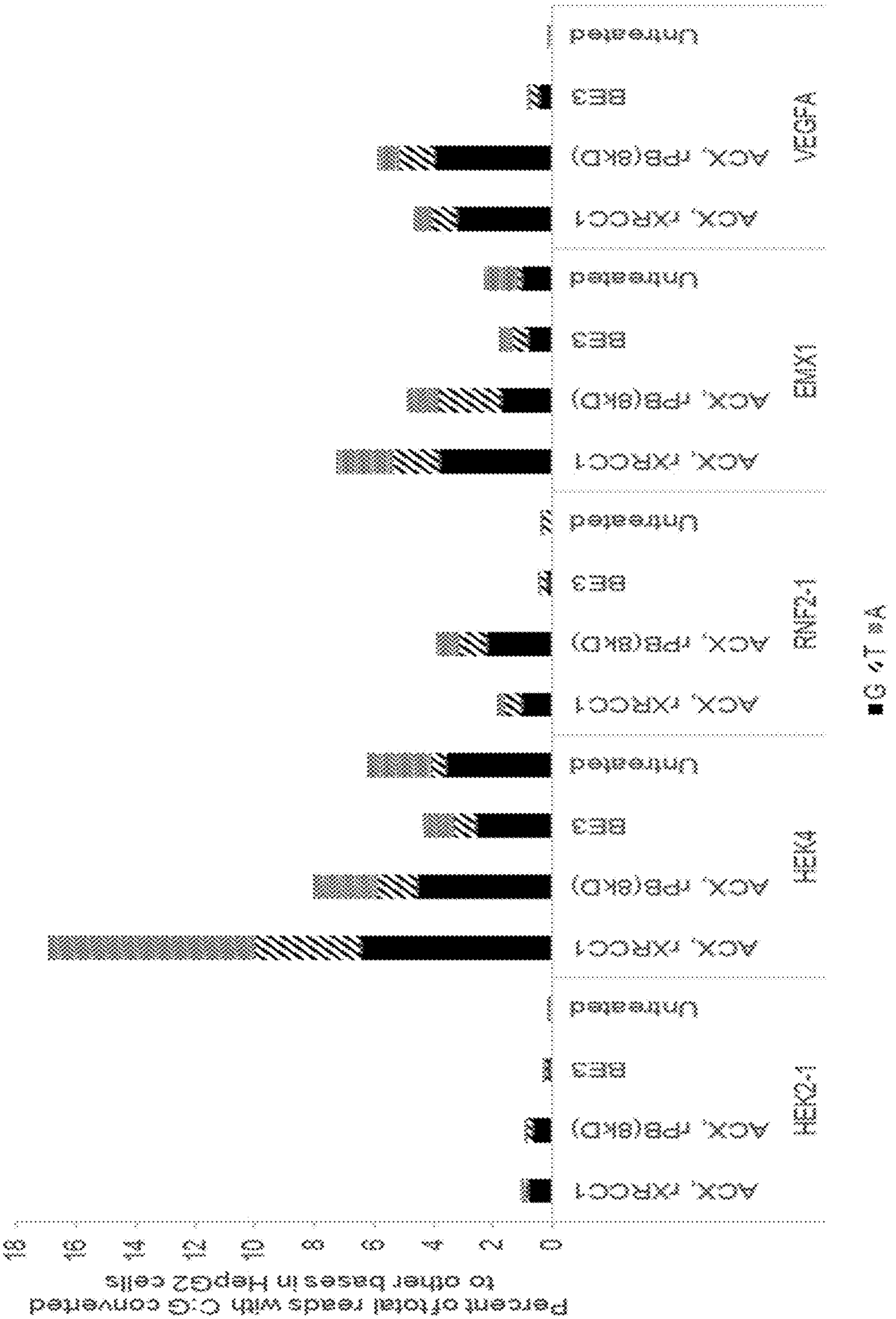
FIG. 18 shows 1 column graph that illustrates C:G editing in HepG2 cells using various gRNA:target site pairs (n=1). These cells were transfected via nucleofection.
Figure 19:
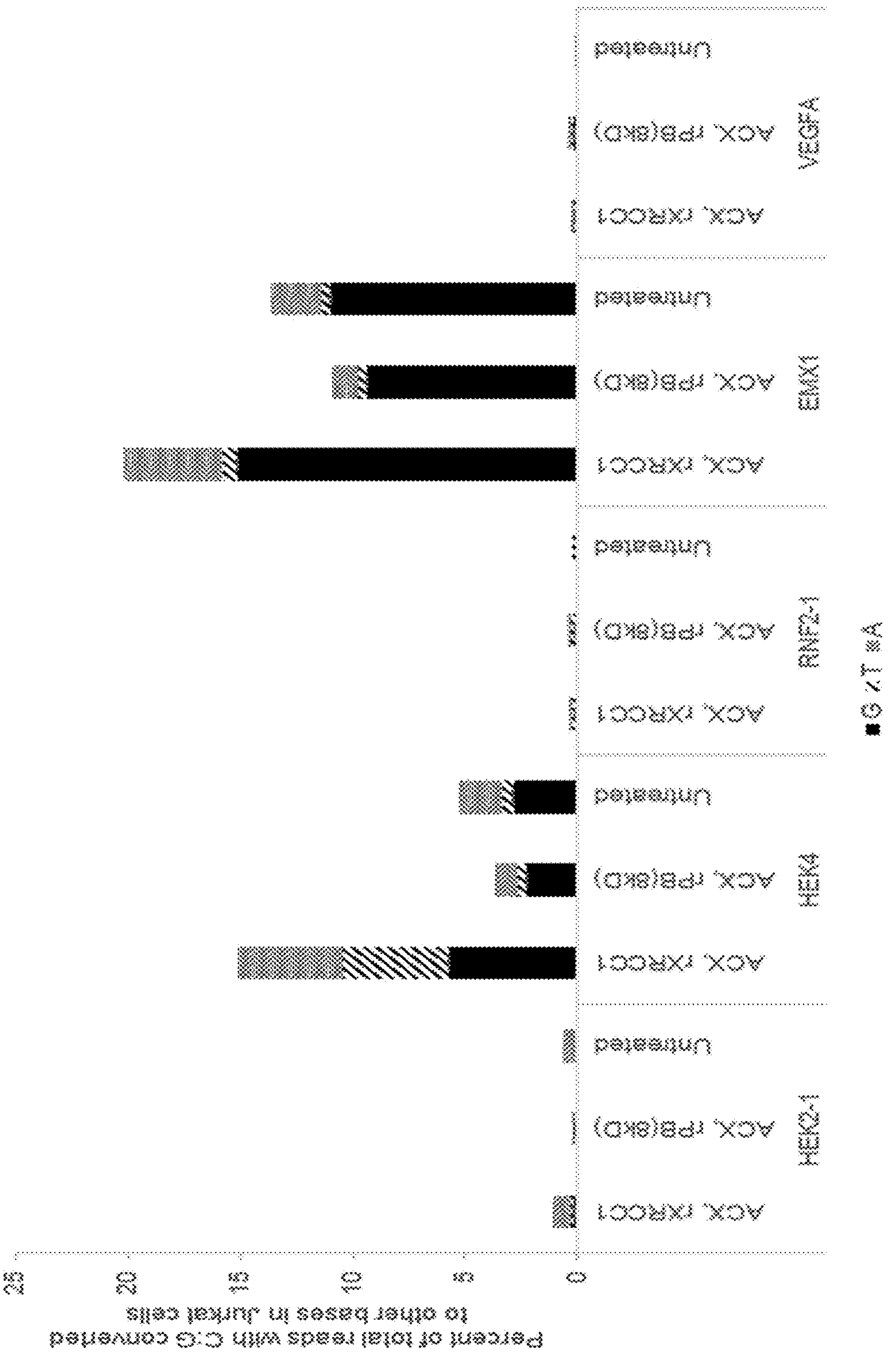
FIG. 19 shows 1 column graph that illustrates C:G editing in Jurkat cells using various gRNA:target site pairs (n=1). These cells were transfected via nucleofection.
Figure 20:
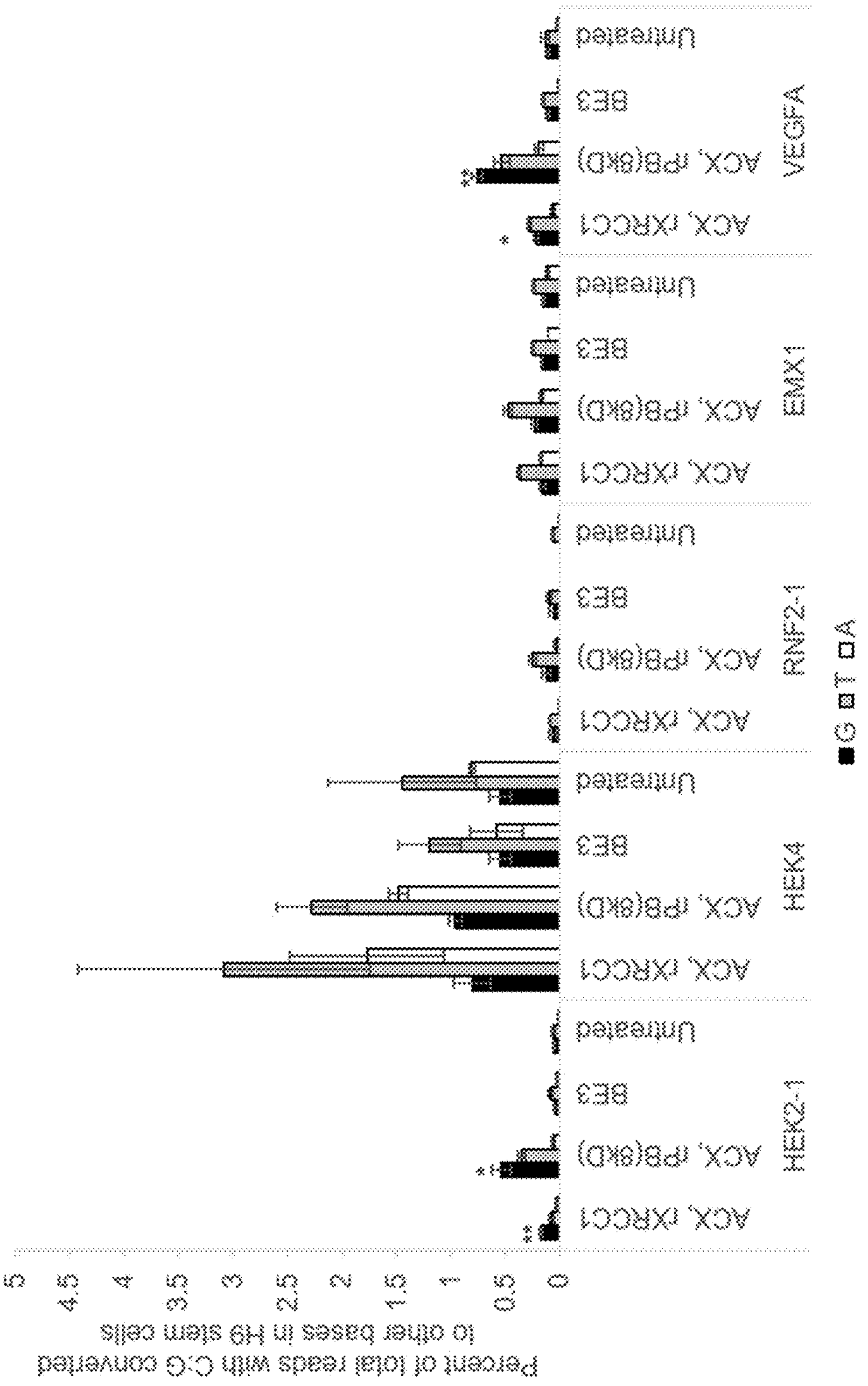
FIG. 20 shows 1 column graph that illustrates C:G editing in H9 stem cells using various gRNA:target site pairs (n=3, error bars denote standard error). Without further engineering (via codon optimization, APOBEC mutation etc.), BE3 is inefficient at inducing C:G to T:A edits in H9 stem cells. The highest C:G to T:A editing observed with BE3 is at HEK4 (1.2%). Similarly, both CGBEs are not efficient at inducing C:G to G:C edits, with the highest edits also at HEK4. It was recently shown that the engineered human APOBEC3A22 can increase BE3 editing in stem cells23, suggesting that a similar approach might also induce higher CGBE stem cell editing. *p<0.05; p<0.01; *p<0.001 (two tailed Student's T-test against 'Untreated,' n=3, mean±standard error).

One limitation of BE3 is its low efficiency in some cell types. With BE3, low C:G to T:A editing was observed in H9 stem cells at five genomic sites (with a maximum of 1.2% C:G to T:A editing at HEK4; FIG. 20*b*). The CGBEs exhibited similarly low C:G to G:C editing efficiencies in the H9 stem cells when evaluated side-by-side. The low editing might be due to chromosomal abnormalities and different methylation profiles in stem cells. It is known that genomic DNA tends to be more highly methylated in undifferentiated stem cells. While methylation does not lead to sequence changes, such epigenetic modifications may reduce editing efficiency by inhibiting deaminase activity. APOBEC activity on methylated C is therefore disfavored. Without the C deamination, base editing cannot be initiated with this APOBEC. Since APOBEC is inefficient at deaminating methylated cytidines, further APOBEC engineering, alongside codon optimization, might be needed to enhance the efficiency of CGBEs in stem cells. In contrast, in the eHAP cell line, moderate levels of editing was observed with the CGBE (ACX, rXRCC1) inducing up to 8.5% C:G to G:C editing at the RNF2 and VEGFA sites, while BE3 induced 0.9% C:G to T:A editing (FIG. 17*b*). The eHAP data suggests that the CGBEs may be moderately efficient in some cell types even if different base editing technology is not. In HTB9 cells—a urinary bladder cancer cell line, both BE3 and the CGBEs can efficiently induce the desired mutations at many sites (up to 17% C:G to G:C editing with CGBE and up to 18% C:G to T:A editing with BE3; FIG. 14*b*). ACX, rPB(8 kD) appears to consistently outperform ACX, rXRCC1 in HTB9 cells, indicating that different CGBE architecture can be employed for optimal performance according to cell types. It was demonstrated that CGBEs is functional across multiple cell types, and that absolute efficiency is partially dependent on the cell type and state, features shared with previous base editors.

Figure 11:
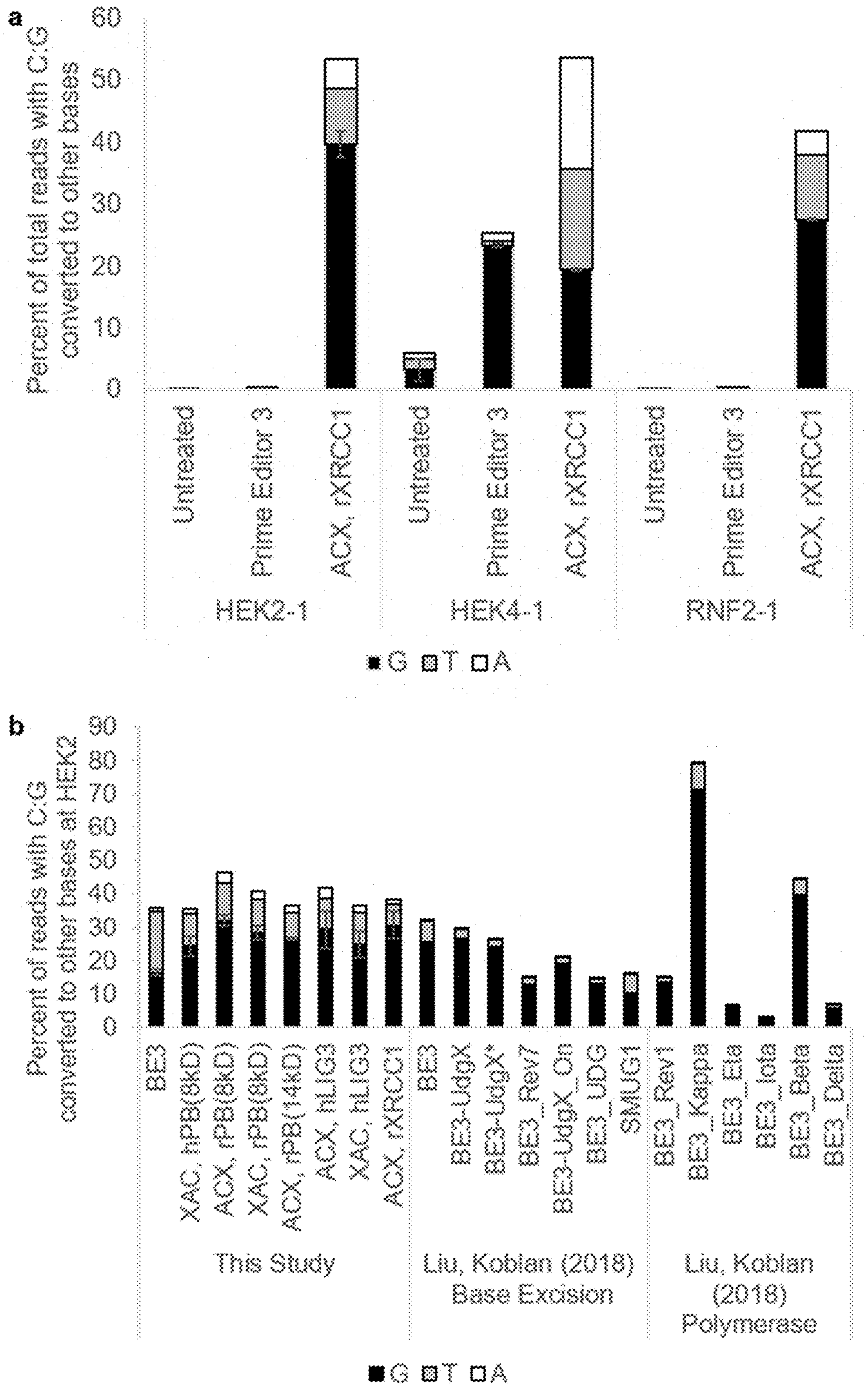
FIG. 11 shows 4 column graphs that illustrates the comparison of the CGBE of the present disclosure to (a) PE3 described in Anzalone et al., and CGBEs described in Liu and Koblan at (b) HEK2, (c) FANCF, and (d) RNF2. (a) As positive controls for prime editing, we used previously published pegRNA (Addgene #132778) targeting HEK3 and observed efficient prime editing (data not shown). For C:G to G:C editing, PE3 is as efficient as CGBE (ACX, rXRCC1) and induced lower levels of undesired edits at HEK4-1. At HEK2-1 and RNF2-1, PE3 is substantially less efficient than CGBE at HEK2 and RNF2. The results indicate that while PE3 may be able to perform C:G to G:C transversions at some sites, CGBE is a valuable tool to expand the editing capabilities of current technologies (n=2, mean±standard error). For parts b, c, and d, since datasets were generated independently and in different cell types, comparisons should be made only against BE3 common to the two studies. Fusion of base excision enzymes such as UDG and UdgX decreases C:G to G:C editing beyond BE3 at 2 of 3 sites (n=1; Liu and Koblan, 2018). Fusion of base excision repair enzymes such as rXRCC1 increases C:G to G:C editing beyond BE3. *p<0.05; p<0.01; *p<0.001 (one-way ANOVA against 'BE3,' Dunn-Šidák; n=3, mean±standard error; this study).
Figure 11:
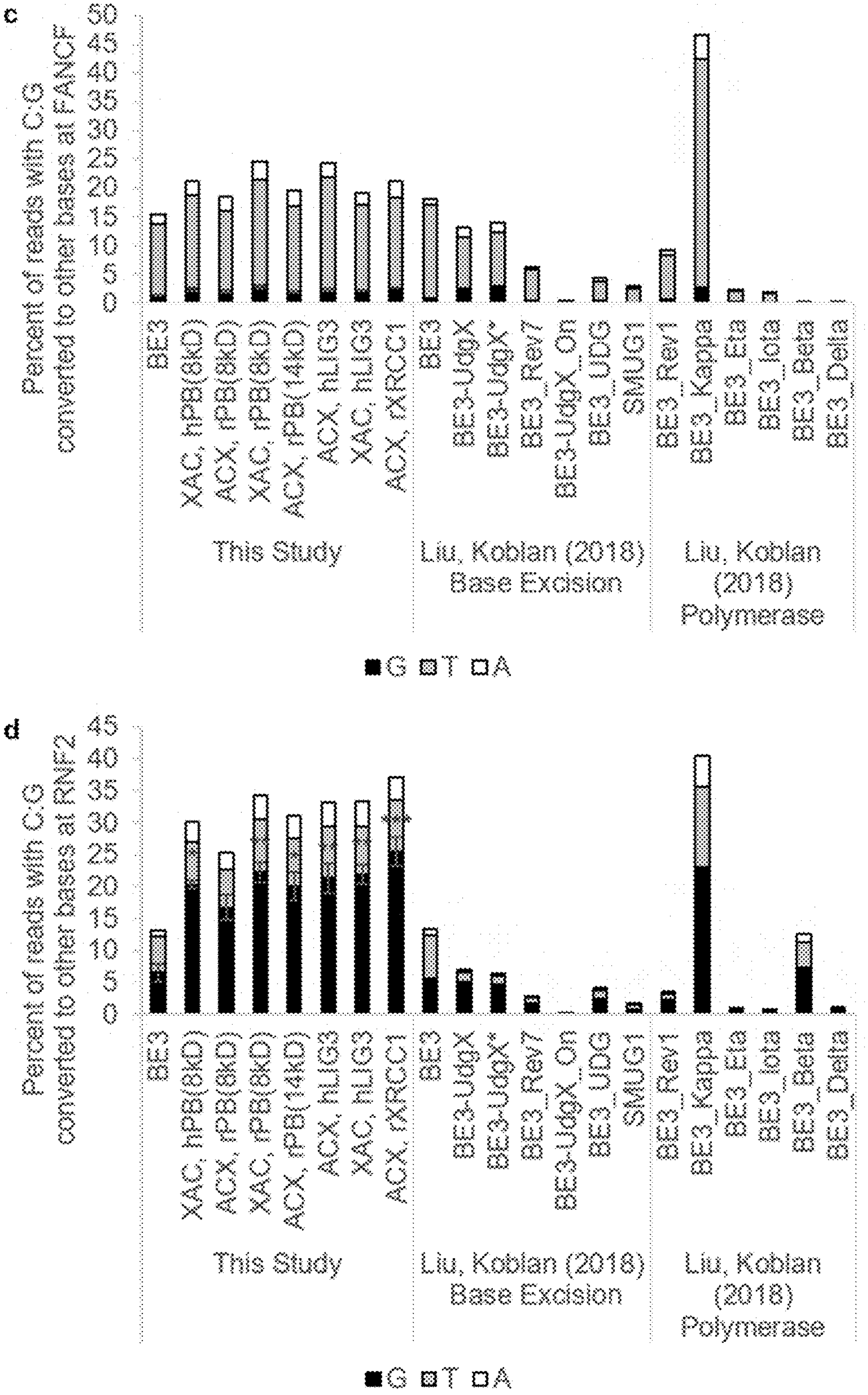
Figure 12:
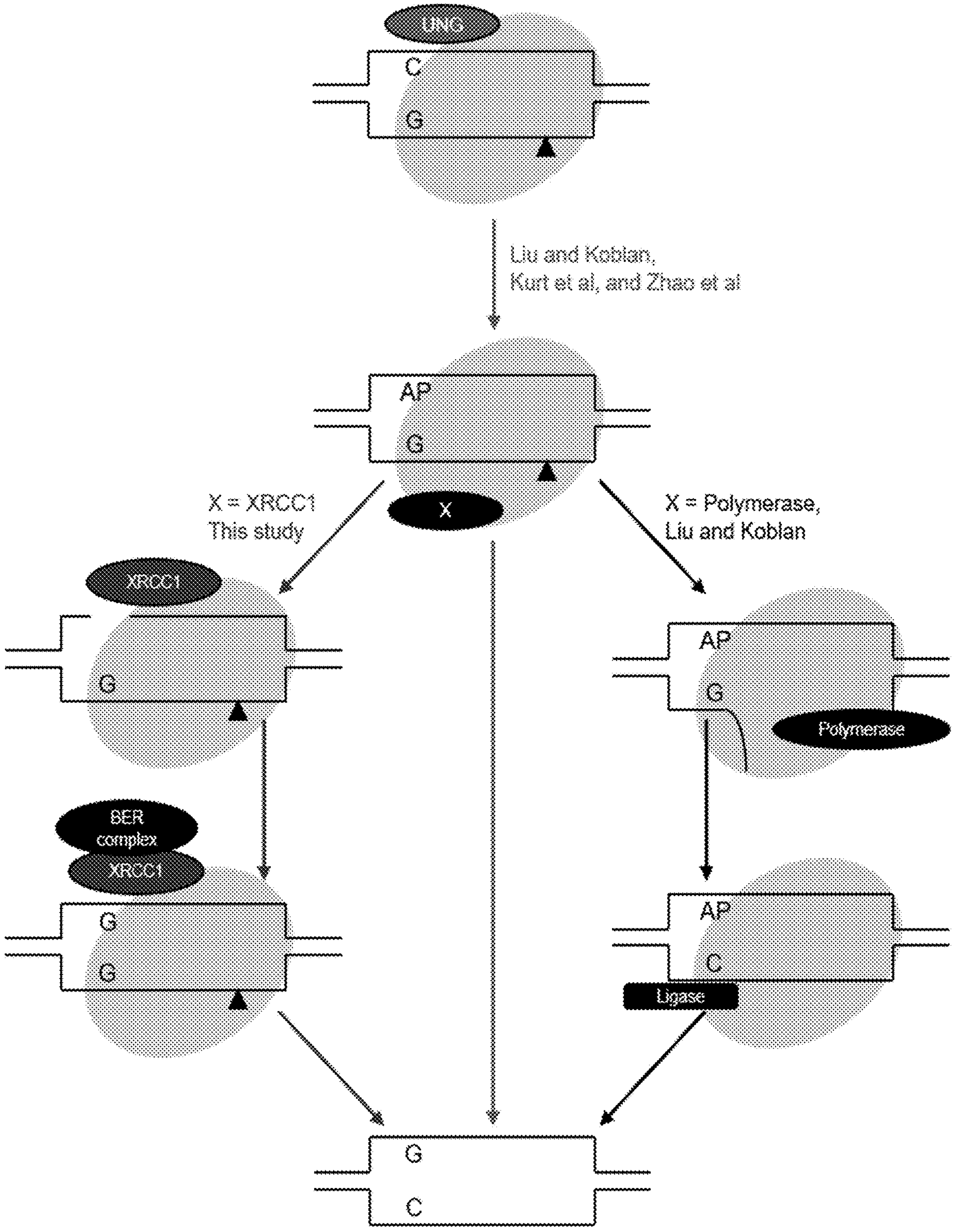
FIG. 12 is a diagrammatic representation of the distinct strategies for CGBE design. This study employs a CGBE design strategy (left) where Cas9 is fused to protein(s) involved in repairing uracil-containing or abasic sites (AP). The activities of these BER proteins are expected to convert the AP to G before the nucleotide on the opposite strand is converted from G to C. In contrast, the polymerase strategy employed by Liu and Koblan (right) seeks to maintain the abasic site throughout a translesion synthesis envisioned to occur on the opposite strand. The AP is repaired after the nucleotide on the opposite strand is converted from G to C. The UNG-based CGBE strategy employed by Kurt et al, Zhao et al, and Liu and Koblan seeks to facilitate the generation of the AP site (middle). In other words, this study employs proteins that repair and not maintain/generate abasic sites whereas other studies employ proteins that generate/maintain and not repair abasic sites. CGBEs were designed based on working hypotheses derived from known Cas9 and BER chemistries.
Figure 13:
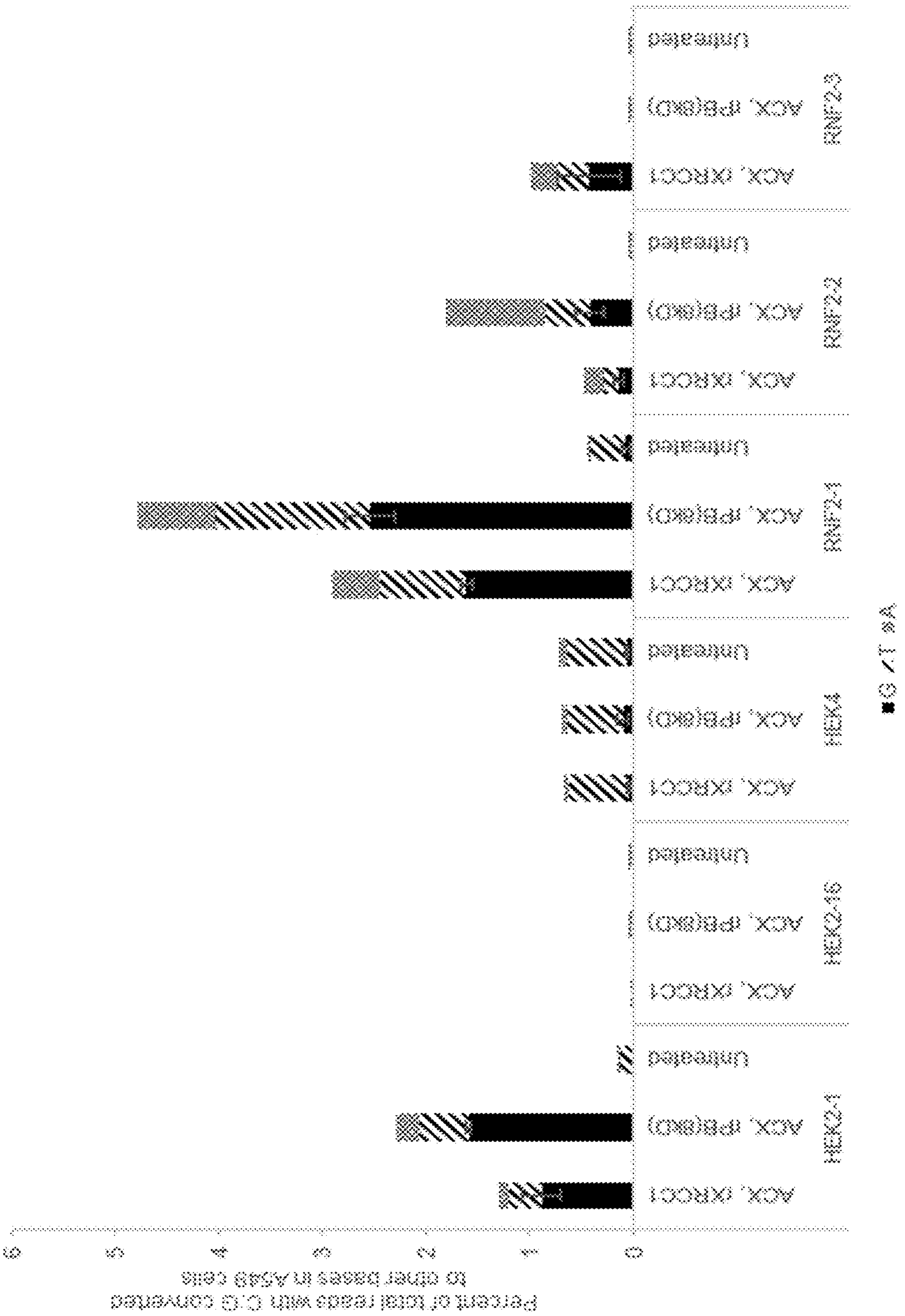
FIG. 13 shows 1 column graph that illustrates C:G editing in A549 cells using various gRNA:target site pairs. (n=2, error bars denote standard error). These cells were transfected via lipofection.

CGBEs that target cytosine within a specified window and convert it into guanine as a predominant editing product were then developed. In separate works, Liu and Koblan designed CGBE candidates by fusing UDG (UNG), UdgX, and polymerases with rAPOBEC-nCas9 (FIG. 11). Both the CGBEs described by Liu and Koblan and the CGBEs disclosed herein induce a C to U change via rAPOBEC and envision this U to be further converted to an abasic site; but the strategy involved and downstream resolution of this abasic site are distinctly different. In Liu and Koblan's work, fusing UNG to rAPOBEC-nCas9 increases the amount of C:G to G:C edits by further increasing the generation of abasic sites (FIG. 12). In contrast, the present disclosure focuses on manipulating DNA repair downstream of abasic site creation, reasoning that APOBEC-nCas9 is already able to generate a significant amount of C:G to G:C editing (FIG. 3*a*, BE3 (no UGI)).

Koblan and Liu's work seeks to induce base excision and perform a translesion polymerization across the targeted abasic site (FIG. 12). This proposed mechanism is unlikely to be the case for the CGBEs of the present disclosure. Instead, the mechanism of the presently disclosed CGBEs is that upon creation of an abasic site in the Cas9-induced R-loop, cellular UNG is displaced by APE1, after which XRCC1 recruits various BER components to repair the abasic site independently of the unedited opposite strand, giving rise to guanine as the major product. Subsequent DNA repair converts the G:G mismatch to G:C. Such a hypothesis would be consistent with a) the tight binding of Cas9 on its target strand, which renders that strand less accessible to other enzymes; b) the accessibility of the deaminated strand as a single-strand of the R-loop; c) the detrimental effect of UDG and UdgX on C:G to G:C editing (FIG. 11), which suggests that the persistence of an UDG-bound site or abasic site might act against the C:G to G:C reaction; and d) the C:G to G:C editing effected by the CGBEs of the present disclosure with domains that do not have intrinsic polymerase activity but are key drivers of abasic site repair. While further mechanistic studies and development continue, CGBEs expand the growing suite of precise genome-editing tools that include CBEs, ABEs, CGBEs and prime editors (FIG. 11), together enabling the precise and efficient engineering of DNA for research, biological interrogation, and disease correction.

Experimental Section

Constructs and Molecular Cloning

The BE3 (Addgene plasmid #73021), prime editor 2 (Addgene plasmid #132775), pegRNA-HEK3_CTT_ins (Addgene plasmid #132778) plasmids are used in the present disclosure. The BE3 plasmid is a mammalian expression plasmid with BE3 being driven by a CMV promoter. hXRCC1 (pTXG-hXRCC1) and hLIG3 (pGEX4T-hLIG3) (Addgene plasmid #52283 and #81055 respectively) are also used. The mutation R400Q is introduced to hXRCC1 and N628K is introduced to hLIG3 via blunt-end ligation. Briefly, plasmid containing either hXRCC1 or hLIG3 is amplified via PCR using Q5 Hot Start HiFi 2× Master Mix (NEB, M0494). PCR product is then treated with DpnI (NEB, R0176) and T4 Polynucleotide Kinase (NEB, M0201) at 37° C. for 30 minutes and inactivated at 65° C. for 20 minutes before being ligated using T4 DNA Ligase (NEB, M0202; room temperature for 2 hours). Ligated product is then transformed into chemically competent 5-alpha *Escherichia Coli* (NEB, C2987). rXRCC1, rLIG3, hPBs, and rPBs were obtained as human codon-optimized de novo synthesized gene fragments (Twist Biosciences). All other oligonucleotides used in the study were de novo synthesized (IDT DNA). To fuse BER proteins with rAPOBEC-nCas9, Q5 Hot Start HiFi 2× Master Mix was used to generate Gibson fragments of the BER proteins as Gibson inserts. After checking PCR products on a gel, Gibson insert and vector were incubated with NEBuilder HiFi DNA Assembly Master Mix (NEB, E2621) for 1 hour at 50° C. The Gibson reaction is then transformed into chemically competent *Escherichia Coli.*

All assembled plasmids were Sanger sequenced for sequence verification and were prepared using either the PureYield Plasmid Miniprep System (Promega, A1223) or Plasmid Plus Maxi Kit (Qiagen, 12965).

Cell Culture, Transfection, and Genomic DNA Harvest

HEK293AAV cells (Agilent, 240073) were maintained in DMEM with GlutaMAX and sodium pyruvate (Thermo Fisher, 10569-010) supplemented with 10% HI FBS (Thermo Fisher) at 37° C. and 5% CO2. HTB-9 cells (ATCC, 5637) were maintained in RPMI-1640 with L-glutamine and sodium bicarbonate (Sigma, R8758) supplemented with 10% HI FBS (Thermo Fisher) and 1% MEM Non-Essential Amino Acids Solution (Thermo Fisher, 11140050) at 37° C. and 5% CO2. Both HTB9 and HEK cells were transfected via lipofection. After cells reached ~80% confluency, they were washed with PBS, pH 7.2 (Thermo Fisher, 20012-027) before being treated with TrypLE Express (Thermo Fisher, 12604). 30,000 cells were added to each well of a 48-well plate one day before transfection. For each well, 750 ng of base-editor plasmid, 250 ng of gRNA plasmid, and 20 ng of GFP plasmid were transfected into these cells using Lipofectamine 3000 (Invitrogen, L3000015) according to the manufacturer's protocol. The media were replaced with fresh media 24 hours after transfection. For prime editing, 750 ng of PE plasmid, 250 ng of pegRNA, and 83 ng of sgRNA were used for transfection. 72 hours after transfection, media were removed; cells were washed with 50 μL PBS, pH 7.2, and genomic DNA was extracted using 50 μL of Quick Extract DNA Extract Solution (Lucigen, QE09050) per well according to manufacturer's protocol. All sample sizes indicate biological replicates.

Jurkat cells (ATCC, TIB-152, Clone E6-1) were maintained in RPMI-1640 with L-glutamine and sodium bicarbonate (Sigma, R8758) supplemented with 10% HI FBS (Thermo Fisher) and 1% MEM Non-Essential Amino Acids Solution (Thermo Fisher, 11140050) at 37° C. and 5% CO2. 200,000 cells were nucleofected with 750 ng of base editor and 250 ng of gRNA expression plasmids using the SE Cell Line 4D-Nucleofector X Kit S (Lonza) and program CL-120 on the 4D X-Unit.

HepG2 cells were maintained in IMDM (Thermo Fisher, 31980-030) supplemented with 10% FBS (Thermo Fisher) and 1% NEAA (Thermo Fisher, 11140050) at 37° C. and 5% CO2. 200,000 cells were nucleofected with 750 ng of base editor and 250 ng of gRNA expression plasmids using the SF Cell Line 4D-Nucleofector X Kit S (Lonza) and program EH-100 on the 4D X-Unit.

eHAP cells (Horizon Discovery, C669) were maintained in IMDM (Thermo Fisher, 31980-030) supplemented with 10% FBS at 37° C. and 5% CO2. 200,000 cells were nucleofected with 750 ng of base editor and 250 ng of gRNA expression plasmids using the SE Cell Line 4D-Nucleofector X Kit S (Lonza) and program DS-138 on the 4D X-Unit.

H9 stem cells (WiCell, WA09) were maintained in mTeSR1 (Stemcell technology, 85850). 200,000 cells were nucleofected with 1500 ng of base editor and 500 ng of gRNA expression plasmids using the P3 Primary Cell kit (Lonza, V4XP-3024) and program hES H9 program on the 4D X-Unit.

Sequencing of Genomic DNA

Sites of interest were prepared for high-throughput sequencing via two PCR amplifications—the first PCR amplifies the region of interest while the second PCR adds appropriate sequencing barcodes. The first PCR was performed in commonly used methods. Primers for the second PCR are based off Illumina adaptors. Amplicons from the second PCR were then pooled and gel extracted (Promega, A9282) to make the final library, which was quantified via Qubit fluorometer (Thermo Fisher) and sequenced on an Illumina iSeq 100 according to the manufacturer's protocol. The resultant FASTQ files were analyzed using CRISPResso2. All sample sizes indicate biological replicates.

Statistical analyses were performed on Matlab. Weblogos were created using Weblogo 3.

REFERENCES

1. Komor, A. C., Kim, Y. B., Packer, M. S., Zuris, J. A., Liu, D. R. Programmable editing of a target base in genomic DNA without double-stranded DNA cleavage. *Nature* 533, 420-424 (2016).
2. Nishida, K. et al. Targeted nucleotide editing using hybrid prokaryotic and vertebrate adaptive immune systems. *Science* 353, aaf8729 (2016).
3. Gaudelli, N. M. et al. Programmable base editing of A*T to G*C in genomic DNA without DNA cleavage. *Nature* 551, 464-471 (2017).
4. Komor, A. C. et al. Improved base excision repair inhibition and bacteriophage Mu Gam protein yields C:G-to-T:A base editors with higher efficiency and product purity. *Sci. Adv.* 3, eaao4774 (2017).
5. Anzalone, A. V. et al. Search-and-replace genome editing without double-strand breaks or donor DNA. *Nature* 576, 149-157 (2019).
6. Kurt, I. C. et al. CRISPR C-to-G base editors for inducing targeted DNA transversions in human cells. *Nat. Biotechnol.* (2020). https://doi.org/10.1038/s41587-020-0609-x
7. Zhao, D. et al. New base editors change C to A in bacteria and C to G in mammalian cells. *Nat. Biotechnol.* (2020). https://doi.org/10.1038/s41587-020-0592-2
8. Liu, D. R., Koblan, L. W. Cytosine to Guanine Base Editor. *World Intellectual Property Organization* (2018).

SEQUENCE LISTING (105 sequences)

SEQ ID NO: 1 - protein, 1368 aa, Artificial Sequence
  nCas9 (Cas9 nickase)
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 2 - protein, 1368 aa, Artificial Sequence [sequence omitted]

SEQ ID NO: 3 - protein, 229 aa, Artificial Sequence [sequence omitted]

SEQ ID NO: 4 - protein, 631 aa, Artificial Sequence
  rXRCC1
MPEISLRHVVSCSSQDSTHRAENLLKADTYRKWRSAKAGEKTISVVLQLEKEEQIHSVDIGNDGSAFVEVLVGSSAGGATAGEQDYEVLLVTSSFMSPSESRSGSNPNRVRIFGPDKLVRAAAEKRWDRVKIVCSQPYSKDSPYGLSFVKFHSPPDKDEAEAPSQKVTVTKLGQFRVKEEDDSANSLRPGALFFNRINKAASASASDPAGPSYAAATLQASSAASSALPVPKVGGSSSKLQEPPKGKRKLDLGLEDSKPPSKPSAGPAALKRPKLPVPSRTPAATPASTPAQKAVPGKPRGEGTEPRGARAGPQELGKILQGVVVVLSGFQNPFRSELRDKALELGAKYRPDWTPDSTHLICAFANTPKYSQVLGLGGRIVRKEWVLDCYRMRRRLPSRRYLMAGLGSSSEDEGDSHSESGEDEAPKLPRKRPQPKAKTQAAGPSSPPRPPTPEETKAPSPGPQDNSDTDGEQSEGRDNGAEDSGDTEDELRRVAKQREQRQPPAPEENGEDPYAGSTDENTDSEAPSEADLPIPELPDFFQGKHFFLYGEFPGDERRKLIRYVTAFNGELEDYMSDRVQFVITAQEWDPNFEEALMENPSLAFVRPRWIYSCNEKQKLLPHQLYGVVPQA

SEQ ID NO: 5 - protein, 634 aa, Artificial Sequence
  hXRCC1
MGPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQA

SEQ ID NO: 6 - protein, 87 aa, Artificial Sequence
  rPB_8KD
MSKRKAPQETLNGGITDMLVELANFEKNVSQAIHKYNAYRKAASVIAKYPHKIKSGAEAKKLPGVGTKIAEKIDEFLATGKLRKLEK

SEQ ID NO: 7 - protein, 141 aa, Artificial Sequence
  rPB_14KD
MSKRKAPQETLNGGITDMLVELANFEKNVSQAIHKYNAYRKAASVIAKYPHKIKSGAEAKKLPGVGTKIAEKIDEFLATGKLRKLEKIRQDDTSSSINFLTRVTGIGPSAARKLVDEGIKTLEDLRKNEDKLNHHQRIGLK

SEQ ID NO: 8 - protein, 87 aa, Artificial Sequence
  hPBI_8KD
MSKRKAPQETLNGGITDMLTELANFEKNVSQAIHKYNAYRKAASVIAKYPHKIKSGAEAKKLPGVGTKIAEKIDEFLATGKLRKLEK

SEQ ID NO: 9 - protein, 141 aa, Artificial Sequence
  hPBI_14KD
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLK

SEQ ID NO: 10 - protein, 943 aa, Artificial Sequence
  rLIG3
MTLAFKTLFPRNLCALGRKELCLFSEQHHWPAIRQFSQWSETNLLCGCCLLQRRKPVLSFQRGHLRPRATHLISWSGSHVGLCTGPCEMAEQRFCVDYAKRGTAGCKKCKEKIVKGVCRIGKVVPNPFSESGGDMKEWYHIKCMFEKLERARATTKKIEDLTELEGWEELEDNEKEQISQHIADLSSKTAATPKKKATVQAKLTTTGQVTSPVKGASFITSTNPRKFSGFSAAKPNNSEQDPSSPAPKTSLSASKCDPKHKDCLLREFRKLCAMVAENPSYNTKTQIIHDFLQKGSTGDGFRGDVYLTVKLLLPGVIKSVYNLNDKQIVKLFSRIFNCNPDDMARDLEQGDVSETIRVFFEQSKSFPPAAKSLLTIQEVDAFLLHLSKLTKEDEQQQALQDIASRCTANDLKCIIRLIKHDLKMNSGAKHVLDALDPNAYEAFKASRNLQDVVERVLHNEQEVEKDPGRRRALSVQASLMTPVQPMLAEACKSIEYAMKKCPNGMFSEIKYDGERVQVHKKGDHFSYFSRSLKPVLPHKVAHFKDYIPKAFPGGQSMILDSEVLLIDNNTGKPLPFGTLGVHKKAAFQDANVCLFVFDCIYFNDVSLMDRPLCERRKFLHDNMVEIRNRIMFSEMKQVTKASDLADMINRVIREGLEGLVLKDVKGTYEPGKRHWLKVKKDYLNEGAMADTADLVVLGAFYGQGSKGGMMSIFLMGCYDPDSQKWCTVTKCAGGHDDATLARLQKELDMVKISKDPSKIPSWLKINKIYYPDFIVPDPKKAAVWEITGAEFSRSEAHTADGISIRFPRCTRIRDDKDWKSATNLPQLKELYQLSKDKADFAVVAGDEGSSTTGGSNGENEGTAGSTVPRKGPKGPPSKSSASAKKTEQKLNDPSSRGGEKLAVKSSPVKVGMKRKAADETPGLTKRRRASRQRGRRAMRTGRR

SEQ ID NO: 11 - protein, 825 aa, Artificial Sequence
  hLIG3
MSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 12 - protein, 335 aa, Artificial Sequence
  Full amino acid sequence of human DNA polymerase beta (PB) (M at start of protein sequence is removed to fuse to Cas9)
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 13 - protein, 335 aa, Artificial Sequence
  Full amino acid sequence of rat DNA polymerase beta (PB) (M at start of protein sequence is removed to fuse to Cas9)
MSKRKAPQETLNGGITDMLVELANFEKNVSQAIHKYNAYRKAASVIAKYPHKIKSGAEAKKLPGVGTKIAEKIDEFLATGKLRKLEKIRQDDTSSSINFLTRVTGIGPSAARKLVDEGIKTLEDLRKNEDKLNHHQRIGLKYFEDFEKRIPREEMLQMQDIVLNEVKKLDPEYIATVCGSFRRGAESSGDMDVLLTHPNFTSESSKQPKLLHRVVEQLQKVRFITDTLSKGETKFMGVCQLPSENDENEYPHRRIDIRLIPKDQYYCGVLYFTGSDIFNKNMRAHALEKGFTINEYTIRPLGVTGVAGEPLPVDSEQDIFDYIQWRYREPKDRSE

SEQ ID NO: 14 - DNA, 96 bp, Artificial Sequence
  EMX1 gRNA
  misc_feature (1)..(20): Spacer
gagtccgagcagaagaagaagttttagagctagaaatagcaagttaaaataaggctagtccgttatcaacttgaaaaagtggcaccgagtcggtgc

SEQ ID NO: 15 - DNA, 96 bp, Artificial Sequence
  FANCF gRNA
  misc_feature (1)..(20): Spacer
ggaatcccttctgcagcaccgttttagagctagaaatagcaagttaaaataaggctagtccgttatcaacttgaaaaagtggcaccgagtcggtgc

SEQ ID NO: 16 - DNA, 96 bp, Artificial Sequence
  HEK2-1 gRNA
  misc_feature (1)..(20): Spacer
gaacacaaagcatagactgcgttttagagctagaaatagcaagttaaaataaggctagtccgttatcaacttgaaaaagtggcaccgagtcggtgc

SEQ ID NO: 17 - DNA, 96 bp, Artificial Sequence
  HEK2-2 gRNA
  misc_feature (1)..(20): Spacer
gagcaccacaccctaaactagttttagagctagaaatagcaagttaaaataaggctagtccgttatcaacttgaaaaagtggcaccgagtcggtgc

SEQ ID NO: 18 - DNA, 96 bp, Artificial Sequence
  HEK2-3 gRNA
  misc_feature (1)..(20): Spacer
ggaaacggatagttctgaaagttttagagctagaaatagcaagttaaaataaggctagtccgttatcaacttgaaaaagtggcaccgagtcggtgc

SEQ ID NO: 19 - DNA, 96 bp, Artificial Sequence
  HEK2-4 gRNA
  misc_feature (1)..(20): Spacer
cttaactatttgtattccacgttttagagctagaaatagcaagttaaaataaggctagtccgttatcaacttgaaaaagtggcaccgagtcggtgc

SEQ ID NO: 20 - DNA, 96 bp, Artificial Sequence
  HEK2-5 gRNA
  misc_feature (1)..(20): Spacer
cttcccaagtgagaagccaggttttagagctagaaatagcaagttaaaataaggctagtccgttatcaacttgaaaaagtggcaccgagtcggtgc

SEQ ID NO: 21 - DNA, 96 bp, Artificial Sequence
  HEK2-6 gRNA
  misc_feature (1)..(20): Spacer
ccagcccgctggccctgtaagttttagagctagaaatagcaagttaaaataaggctagtccgttatcaacttgaaaaagtggcaccgagtcggtgc

SEQ ID NO: 22 - DNA, 96 bp, Artificial Sequence
  HEK2-7 gRNA
  misc_feature (1)..(20): Spacer
cattccgttattttacatatgttttagagctagaaatagcaagttaaaataaggctagtccgttatcaacttgaaaaagtggcaccgagtcggtgc

SEQ ID NO: 23 - DNA, 96 bp, Artificial Sequence
  HEK2-8 gRNA
  misc_feature (1)..(20): Spacer
gtttcctttacagggccagcgttttagagctagaaatagcaagttaaaataaggctagtccgttatcaacttgaaaaagtggcaccgagtcggtgc

SEQ ID NO: 24 - DNA, 96 bp, Artificial Sequence
  HEK2-9 gRNA
  misc_feature (1)..(20): Spacer
atacgcacagtttgacagatgttttagagctagaaatagcaagttaaaataaggctagtccgttatcaacttgaaaaagtggcaccgagtcggtgc

SEQ ID NO: 25 - DNA, 96 bp, Artificial Sequence
  HEK2-10 gRNA
  misc_feature (1)..(20): Spacer
gctggccctgtaaaggaaacgttttagagctagaaatagcaagttaaaataaggctagtccgttatcaacttgaaaaagtggcaccgagtcggtgc

SEQ ID NO: 26 - DNA, 96 bp, Artificial Sequence
  HEK2-11 gRNA
  misc_feature (1)..(20): Spacer
gcatgcgtgtgtgtttaagcgttttagagctagaaatagcaagttaaaataaggctagtccgttatcaacttgaaaaagtggcaccgagtcggtgc

SEQ ID NO: 27 - DNA, 96 bp, Artificial Sequence
  HEK2-12 gRNA
  misc_feature (1)..(20): Spacer
ttgggctgcagtaacttgaagttttagagctagaaatagcaagttaaaataaggctagtccgttatcaacttgaaaaagtggcaccgagtcggtgc

SEQ ID NO: 28 - DNA, 96 bp, Artificial Sequence
  HEK2-13 gRNA
  misc_feature (1)..(20): Spacer
tctttcaagcaggtgattacgttttagagctagaaatagcaagttaaaataaggctagtccgttatcaacttgaaaaagtggcaccgagtcggtgc

SEQ ID NO: 29 - DNA, 96 bp, Artificial Sequence
  HEK2-14 gRNA
  misc_feature (1)..(20): Spacer
agtttcctttacagggccaggttttagagctagaaatagcaagttaaaataaggctagtccgttatcaacttgaaaaagtggcaccgagtcggtgc

SEQ ID NO: 30 - DNA, 96 bp, Artificial Sequence
  HEK2-15 gRNA
  misc_feature (1)..(20): Spacer
gaggtcgtggctgagcacaagttttagagctagaaatagcaagttaaaataaggctagtccgttatcaacttgaaaaagtggcaccgagtcggtgc

SEQ ID NO: 31 - DNA, 96 bp, Artificial Sequence
  HEK2-16 gRNA
  misc_feature (1)..(20): Spacer
ggcctctattgttggtagaagttttagagctagaaatagcaagttaaaataaggctagtccgttatcaacttgaaaaagtggcaccgagtcggtgc

SEQ ID NO: 32 - DNA, 96 bp, Artificial Sequence
  HEK3 gRNA
  misc_feature (1)..(20): Spacer
ggcccagactgagcacgtgagttttagagctagaaatagcaagttaaaataaggctagtccgttatcaacttgaaaaagtggcaccgagtcggtgc

SEQ ID NO: 33 - DNA, 96 bp, Artificial Sequence
  HEK4 gRNA
  misc_feature (1)..(20): Spacer
ggcactgcggctggaggtgggttttagagctagaaatagcaagttaaaataaggctagtccgttatcaacttgaaaaagtggcaccgagtcggtgc

SEQ ID NO: 34 - DNA, 96 bp, Artificial Sequence
  RNF2-1 gRNA
  misc_feature (1)..(20): Spacer
gtcatcttagtcattacctggttttagagctagaaatagcaagttaaaataaggctagtccgttatcaacttgaaaaagtggcaccgagtcggtgc

SEQ ID NO: 35 - DNA, 96 bp, Artificial Sequence
  RNF2-2 gRNA
  misc_feature (1)..(20): Spacer
cacacacacttagaatctgtgttttagagctagaaatagcaagttaaaataaggctagtccgttatcaacttgaaaaagtggcaccgagtcggtgc

SEQ ID NO: 36 - DNA, 96 bp, Artificial Sequence
  RNF2-3 gRNA
  misc_feature (1)..(20): Spacer
acacacacacttagaatctggttttagagctagaaatagcaagttaaaataaggctagtccgttatcaacttgaaaaagtggcaccgagtcggtgc

SEQ ID NO: 37 - DNA, 96 bp, Artificial Sequence
  GJB2 gRNA
  misc_feature (1)..(20): Spacer
ggacacgaagatcagctgcagttttagagctagaaatagcaagttaaaataaggctagtccgttatcaacttgaaaaagtggcaccgagtcggtgc

SEQ ID NO: 38 - DNA, 96 bp, Artificial Sequence
  ADRB2 gRNA
  misc_feature (1)..(20): Spacer
ccctttcctgcgtgacgtcggttttagagctagaaatagcaagttaaaataaggctagtccgttatcaacttgaaaaagtggcaccgagtcggtgc

SEQ ID NO: 39 - DNA, 96 bp, Artificial Sequence; identical to SEQ ID NO: 38
  MYBPC3 gRNA
  misc_feature (1)..(20): Spacer

SEQ ID NO: 40 - DNA, 96 bp, Artificial Sequence
  GAL 292 gRNA
  misc_feature (1)..(20): Spacer
gaagtcgttgtcaaacaggagttttagagctagaaatagcaagttaaaataaggctagtccgttatcaacttgaaaaagtggcaccgagtcggtgc

SEQ ID NO: 41 - DNA, 96 bp, Artificial Sequence
  VEGFA-1 gRNA
  misc_feature (1)..(20): Spacer
gatgtctgcaggccagatgagttttagagctagaaatagcaagttaaaataaggctagtccgttatcaacttgaaaaagtggcaccgagtcggtgc

SEQ ID NO: 42 - protein, 1713 aa, Artificial Sequence
  ACX, hPB(8kD)
  MISC_FEATURE (1)..(229): APOBEC
  MISC_FEATURE (246)..(1612): nCas9
  MISC_FEATURE (1617)..(1702): hPB(8kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLTELANFEKNVSQAIHKYNAYRKAASVIAKYPHKIKSGAEAKKLPGVGTKIAEKIDEFLATGKLRKLEKSGGSPKKKRKV

SEQ ID NO: 43 - protein, 1767 aa, Artificial Sequence
  ACX, hPB(14kD)
  MISC_FEATURE (1)..(229): APOBEC
  MISC_FEATURE (246)..(1612): nCas9
  MISC_FEATURE (1617)..(1756): hPB(14kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKSGGSPKKKRKV

SEQ ID NO: 44 - protein, 1713 aa, Artificial Sequence
  ACX, rPB(8kD)
  MISC_FEATURE (1)..(229): APOBEC
  MISC_FEATURE (246)..(1612): nCas9
  MISC_FEATURE (1617)..(1702): rPB(8kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLVELANFEKNVSQAIHKYNAYRKAASVIAKYPHKIKSGAEAKKLPGVGTKIAEKIDEFLATGKLRKLEKSGGSPKKKRKV

SEQ ID NO: 45 - protein, 1767 aa, Artificial Sequence
  ACX, rPB(14kD)
  MISC_FEATURE (1)..(229): APOBEC
  MISC_FEATURE (246)..(1612): nCas9
  MISC_FEATURE (1617)..(1756): rPB(14kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLVELANFEKNVSQAIHKYNAYRKAASVIAKYPHKIKSGAEAKKLPGVGTKIAEKIDEFLATGKLRKLEKIRQDDTSSSINFLTRVTGIGPSAARKLVDEGIKTLEDLRKNEDKLNHHQRIGLKSGGSPKKKRKV

SEQ ID NO: 46 - protein, 1713 aa, Artificial Sequence
  ACX, hPB(8kD)
  MISC_FEATURE (1)..(229): APOBEC
  MISC_FEATURE (246)..(1612): wtCas9
  MISC_FEATURE (1617)..(1702): hPB(8kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLTELANFEKNVSQAIHKYNAYRKAASVIAKYPHKIKSGAEAKKLPGVGTKIAEKIDEFLATGKLRKLEKSGGSPKKKRKV

SEQ ID NO: 47 - protein, 1767 aa, Artificial Sequence
  ACX, hPB(14kD)
  MISC_FEATURE (1)..(229): APOBEC
  MISC_FEATURE (246)..(1612): wtCas9
  MISC_FEATURE (1617)..(1756): hPB(14kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKSGGSPKKKRKV

SEQ ID NO: 48 - protein, 1713 aa, Artificial Sequence
  ACX, rPB(8kD)
  MISC_FEATURE (1)..(229): APOBEC
  MISC_FEATURE (246)..(1612): wtCas9
  MISC_FEATURE (1617)..(1702): rPB(8kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLVELANFEKNVSQAIHKYNAYRKAASVIAKYPHKIKSGAEAKKLPGVGTKIAEKIDEFLATGKLRKLEKSGGSPKKKRKV

SEQ ID NO: 49 - protein, 1767 aa, Artificial Sequence
  ACX, rPB(14kD)
  MISC_FEATURE (1)..(229): APOBEC
  MISC_FEATURE (246)..(1612): wtCas9
  MISC_FEATURE (1617)..(1756): rPB(14kD)
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKRKAPQETLNGGITDMLVELANFEKNVSQAIHKYNAYRKAASVIAKYPHKIKSGAEAKKLPGVGTKIAEKIDEFLATGKLRKLEKIRQDDTSSSINFLTRVTGIGPSAARKLVDEGIKTLEDLRKNEDKLNHHQRIGLKSGGSPKKKRKV

SEQ ID NO: 50 - protein, 1713 aa, Artificial Sequence
  AXC, hPB(8kD)
  MISC_FEATURE (1)..(229): APOBEC
  MISC_FEATURE (234)..(319): hPB(8kD)
  MISC_FEATURE (336)..(1702): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSKRKAPQETLNGGITDMLTELANFEKNVSQAIHKYNAYRKAASVIAKYPHKIKSGAEAKKLPGVGTKIAEKIDEFLATGKLRKLEKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 51 - protein, 1767 aa, Artificial Sequence
  AXC, hPB(14kD)
  MISC_FEATURE (1)..(229): APOBEC
  MISC_FEATURE (234)..(373): hPB(14kD)
  MISC_FEATURE (390)..(1756): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 52 - protein, 1713 aa, Artificial Sequence
  AXC, rPB(8kD)
  MISC_FEATURE (1)..(229): APOBEC
  MISC_FEATURE (234)..(319): rPB(8kD)
  MISC_FEATURE (336)..(1702): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSKRKAPQETLNGGITDMLVELANFEKNVSQAIHKYNAYRKAASVIAKYPHKIKSGAEAKKLPGVGTKIAEKIDEFLATGKLRKLEKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 53 - protein, 1767 aa, Artificial Sequence
  AXC, rPB(14kD)
  MISC_FEATURE (1)..(229): APOBEC
  MISC_FEATURE (234)..(373): rPB(14kD)
  MISC_FEATURE (390)..(1756): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSKRKAPQETLNGGITDMLVELANFEKNVSQAIHKYNAYRKAASVIAKYPHKIKSGAEAKKLPGVGTKIAEKIDEFLATGKLRKLEKIRQDDTSSSINFLTRVTGIGPSAARKLVDEGIKTLEDLRKNEDKLNHHQRIGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 54 - protein, 1713 aa, Artificial Sequence
  XAC, hPB(8kD)
  MISC_FEATURE (1)..(87): hPB(8kD)
  MISC_FEATURE (92)..(319): APOBEC
  MISC_FEATURE (336)..(1702): nCas9
MSKRKAPQETLNGGITDMLTELANFEKNVSQAIHKYNAYRKAASVIAKYPHKIKSGAEAKKLPGVGTKIAEKIDEFLATGKLRKLEKSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 55 - protein, 1767 aa, Artificial Sequence
  XAC, hPB(14kD)
  MISC_FEATURE (1)..(141): hPB(14kD)
  MISC_FEATURE (146)..(373): APOBEC
  MISC_FEATURE (390)..(1756): nCas9
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 56 - protein, 1713 aa, Artificial Sequence
  XAC, rPB(8kD)
  MISC_FEATURE (1)..(87): rPB(8kD)
  MISC_FEATURE (92)..(319): APOBEC
  MISC_FEATURE (336)..(1702): nCas9
MSKRKAPQETLNGGITDMLVELANFEKNVSQAIHKYNAYRKAASVIAKYPHKIKSGAEAKKLPGVGTKIAEKIDEFLATGKLRKLEKSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 57 - protein, 1767 aa, Artificial Sequence
  XAC, rPB(14kD)
  MISC_FEATURE (1)..(141): rPB(14kD)
  MISC_FEATURE (146)..(373): APOBEC
  MISC_FEATURE (390)..(1756): nCas9
MSKRKAPQETLNGGITDMLVELANFEKNVSQAIHKYNAYRKAASVIAKYPHKIKSGAEAKKLPGVGTKIAEKIDEFLATGKLRKLEKIRQDDTSSSINFLTRVTGIGPSAARKLVDEGIKTLEDLRKNEDKLNHHQRIGLKSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 58 - protein, 2260 aa, Artificial Sequence
  ACX, hXRCC1
  MISC_FEATURE (1)..(229): APOBEC
  MISC_FEATURE (246)..(1612): nCas9
  MISC_FEATURE (1617)..(2249): hXRCC1
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQASGGSPKKKRKV

SEQ ID NO: 59 - protein, 2260 aa, Artificial Sequence
  ACX, hXRCC1
  MISC_FEATURE (1)..(229): APOBEC
  MISC_FEATURE (246)..(1612): wtCas9
  MISC_FEATURE (1617)..(2249): hXRCC1
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSGPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQASGGSPKKKRKV

SEQ ID NO: 60 - protein, 2260 aa, Artificial Sequence
  AXC, hXRCC1
  MISC_FEATURE (1)..(229): APOBEC
  MISC_FEATURE (234)..(866): hXRCC1
  MISC_FEATURE (883)..(2249): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSGPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQASGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 61 - protein, 2260 aa, Artificial Sequence
  XAC, hXRCC1
  MISC_FEATURE (1)..(634): hXRCC1
  MISC_FEATURE (639)..(866): APOBEC
  MISC_FEATURE (883)..(2249): nCas9
MGPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDYMSDRVQFVITAQEWDPSFEEALMDNPSLAFVRPRWIYSCNEKQKLLPHQLYGVVPQASGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 62 - protein, 2451 aa, Artificial Sequence
  ACX, hLIG3
  MISC_FEATURE (1)..(229): APOBEC
  MISC_FEATURE (246)..(1612): nCas9
  MISC_FEATURE (1617)..(2440): hLIG3
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPCSGGSPKKKRKV

SEQ ID NO: 63 - protein, 2451 aa, Artificial Sequence
  ACX, hLIG3,
  MISC_FEATURE (1)..(229): APOBEC
  MISC_FEATURE (246)..(1612): wtCas9
  MISC_FEATURE (1617)..(2440): hLIG3
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPCSGGSPKKKRKV

SEQ ID NO: 64 - protein, 2451 aa, Artificial Sequence
  AXC, hLIG3
  MISC_FEATURE (1)..(229): APOBEC
  MISC_FEATURE (234)..(1057): hLIG3
  MISC_FEATURE (1074)..(2440): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPCSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 65 - protein, 2451 aa, Artificial Sequence
  XAC, hLIG3
  MISC_FEATURE (1)..(825): hLIG3
  MISC_FEATURE (830)..(1057): APOBEC
  MISC_FEATURE (1074)..(2440): nCas9
MSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPCSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 66 - protein, 2569 aa, Artificial Sequence
  ACX, rLIG3
  MISC_FEATURE (1)..(229): APOBEC
  MISC_FEATURE (246)..(1612): nCas9
  MISC_FEATURE (1617)..(2558): rLIG3
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTLAFKTLFPRNLCALGRKELCLFSEQHHWPAIRQFSQWSETNLLCGCCLLQRRKPVLSFQRGHLRPRATHLISWSGSHVGLCTGPCEMAEQRFCVDYAKRGTAGCKKCKEKIVKGVCRIGKVVPNPFSESGGDMKEWYHIKCMFEKLERARATTKKIEDLTELEGWEELEDNEKEQISQHIADLSSKTAATPKKKATVQAKLTTTGQVTSPVKGASFITSTNPRKFSGFSAAKPNNSEQDPSSPAPKTSLSASKCDPKHKDCLLREFRKLCAMVAENPSYNTKTQIIHDFLQKGSTGDGFRGDVYLTVKLLLPGVIKSVYNLNDKQIVKLFSRIFNCNPDDMARDLEQGDVSETIRVFFEQSKSFPPAAKSLLTIQEVDAFLLHLSKLTKEDEQQQALQDIASRCTANDLKCIIRLIKHDLKMNSGAKHVLDALDPNAYEAFKASRNLQDVVERVLHNEQEVEKDPGRRRALSVQASLMTPVQPMLAEACKSIEYAMKKCPNGMFSEIKYDGERVQVHKKGDHFSYFSRSLKPVLPHKVAHFKDYIPKAFPGGQSMILDSEVLLIDNNTGKPLPFGTLGVHKKAAFQDANVCLFVFDCIYFNDVSLMDRPLCERRKFLHDNMVEIRNRIMFSEMKQVTKASDLADMINRVIREGLEGLVLKDVKGTYEPGKRHWLKVKKDYLNEGAMADTADLVVLGAFYGQGSKGGMMSIFLMGCYDPDSQKWCTVTKCAGGHDDATLARLQKELDMVKISKDPSKIPSWLKINKIYYPDFIVPDPKKAAVWEITGAEFSRSEAHTADGISIRFPRCTRIRDDKDWKSATNLPQLKELYQLSKDKADFAVVAGDEGSSTTGGSNGENEGTAGSTVPRKGPKGPPSKSSASAKKTEQKLNDPSSRGGEKLAVKSSPVKVGMKRKAADETPGLTKRRRASRQRGRRAMRTGRRSGGSPKKKRKV

SEQ ID NO: 67 - protein, 2569 aa, Artificial Sequence
  ACX, rLIG3
  MISC_FEATURE (1)..(229): APOBEC
  MISC_FEATURE (246)..(1612): wtCas9
  MISC_FEATURE (1617)..(2558): rLIG3
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTLAFKTLFPRNLCALGRKELCLFSEQHHWPAIRQFSQWSETNLLCGCCLLQRRKPVLSFQRGHLRPRATHLISWSGSHVGLCTGPCEMAEQRFCVDYAKRGTAGCKKCKEKIVKGVCRIGKVVPNPFSESGGDMKEWYHIKCMFEKLERARATTKKIEDLTELEGWEELEDNEKEQISQHIADLSSKTAATPKKKATVQAKLTTTGQVTSPVKGASFITSTNPRKFSGFSAAKPNNSEQDPSSPAPKTSLSASKCDPKHKDCLLREFRKLCAMVAENPSYNTKTQIIHDFLQKGSTGDGFRGDVYLTVKLLLPGVIKSVYNLNDKQIVKLFSRIFNCNPDDMARDLEQGDVSETIRVFFEQSKSFPPAAKSLLTIQEVDAFLLHLSKLTKEDEQQQALQDIASRCTANDLKCIIRLIKHDLKMNSGAKHVLDALDPNAYEAFKASRNLQDVVERVLHNEQEVEKDPGRRRALSVQASLMTPVQPMLAEACKSIEYAMKKCPNGMFSEIKYDGERVQVHKKGDHFSYFSRSLKPVLPHKVAHFKDYIPKAFPGGQSMILDSEVLLIDNNTGKPLPFGTLGVHKKAAFQDANVCLFVFDCIYFNDVSLMDRPLCERRKFLHDNMVEIRNRIMFSEMKQVTKASDLADMINRVIREGLEGLVLKDVKGTYEPGKRHWLKVKKDYLNEGAMADTADLVVLGAFYGQGSKGGMMSIFLMGCYDPDSQKWCTVTKCAGGHDDATLARLQKELDMVKISKDPSKIPSWLKINKIYYPDFIVPDPKKAAVWEITGAEFSRSEAHTADGISIRFPRCTRIRDDKDWKSATNLPQLKELYQLSKDKADFAVVAGDEGSSTTGGSNGENEGTAGSTVPRKGPKGPPSKSSASAKKTEQKLNDPSSRGGEKLAVKSSPVKVGMKRKAADETPGLTKRRRASRQRGRRAMRTGRRSGGSPKKKRKV

SEQ ID NO: 68 - protein, 2569 aa, Artificial Sequence
  XAC, rLIG3
  MISC_FEATURE (1)..(943): rLIG3
  MISC_FEATURE (948)..(1175): APOBEC
  MISC_FEATURE (1192)..(2558): nCas9
MTLAFKTLFPRNLCALGRKELCLFSEQHHWPAIRQFSQWSETNLLCGCCLLQRRKPVLSFQRGHLRPRATHLISWSGSHVGLCTGPCEMAEQRFCVDYAKRGTAGCKKCKEKIVKGVCRIGKVVPNPFSESGGDMKEWYHIKCMFEKLERARATTKKIEDLTELEGWEELEDNEKEQISQHIADLSSKTAATPKKKATVQAKLTTTGQVTSPVKGASFITSTNPRKFSGFSAAKPNNSEQDPSSPAPKTSLSASKCDPKHKDCLLREFRKLCAMVAENPSYNTKTQIIHDFLQKGSTGDGFRGDVYLTVKLLLPGVIKSVYNLNDKQIVKLFSRIFNCNPDDMARDLEQGDVSETIRVFFEQSKSFPPAAKSLLTIQEVDAFLLHLSKLTKEDEQQQALQDIASRCTANDLKCIIRLIKHDLKMNSGAKHVLDALDPNAYEAFKASRNLQDVVERVLHNEQEVEKDPGRRRALSVQASLMTPVQPMLAEACKSIEYAMKKCPNGMFSEIKYDGERVQVHKKGDHFSYFSRSLKPVLPHKVAHFKDYIPKAFPGGQSMILDSEVLLIDNNTGKPLPFGTLGVHKKAAFQDANVCLFVFDCIYFNDVSLMDRPLCERRKFLHDNMVEIRNRIMFSEMKQVTKASDLADMINRVIREGLEGLVLKDVKGTYEPGKRHWLKVKKDYLNEGAMADTADLVVLGAFYGQGSKGGMMSIFLMGCYDPDSQKWCTVTKCAGGHDDATLARLQKELDMVKISKDPSKIPSWLKINKIYYPDFIVPDPKKAAVWEITGAEFSRSEAHTADGISIRFPRCTRIRDDKDWKSATNLPQLKELYQLSKDKADFAVVAGDEGSSTTGGSNGENEGTAGSTVPRKGPKGPPSKSSASAKKTEQKLNDPSSRGGEKLAVKSSPVKVGMKRKAADETPGLTKRRRASRQRGRRAMRTGRRSGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 69 - protein, 2257 aa, Artificial Sequence
  ACX, rXRCC1
  MISC_FEATURE (1)..(229): APOBEC
  MISC_FEATURE (246)..(1612): nCas9
  MISC_FEATURE (1617)..(2246): rXRCC1
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPEISLRHVVSCSSQDSTHRAENLLKADTYRKWRSAKAGEKTISVVLQLEKEEQIHSVDIGNDGSAFVEVLVGSSAGGATAGEQDYEVLLVTSSFMSPSESRSGSNPNRVRIFGPDKLVRAAAEKRWDRVKIVCSQPYSKDSPYGLSFVKFHSPPDKDEAEAPSQKVTVTKLGQFRVKEEDDSANSLRPGALFFNRINKAASASASDPAGPSYAAATLQASSAASSALPVPKVGGSSSKLQEPPKGKRKLDLGLEDSKPPSKPSAGPAALKRPKLPVPSRTPAATPASTPAQKAVPGKPRGEGTEPRGARAGPQELGKILQGVVVVLSGFQNPFRSELRDKALELGAKYRPDWTPDSTHLICAFANTPKYSQVLGLGGRIVRKEWVLDCYRMRRRLPSRRYLMAGLGSSSEDEGDSHSESGEDEAPKLPRKRPQPKAKTQAAGPSSPPRPPTPEETKAPSPGPQDNSDTDGEQSEGRDNGAEDSGDTEDELRRVAKQREQRQPPAPEENGEDPYAGSTDENTDSEAPSEADLPIPELPDFFQGKHFFLYGEFPGDERRKLIRYVTAFNGELEDYMSDRVQFVITAQEWDPNFEEALMENPSLAFVRPRWIYSCNEKQKLLPHQLYGVVPQASGGSPKKKRKV

SEQ ID NO: 70 - protein, 2257 aa, Artificial Sequence
  ACX, rXRCC1
  MISC_FEATURE (1)..(229): APOBEC
  MISC_FEATURE (246)..(1612): wtCas9
  MISC_FEATURE (1617)..(2246): rXRCC1
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPEISLRHVVSCSSQDSTHRAENLLKADTYRKWRSAKAGEKTISVVLQLEKEEQIHSVDIGNDGSAFVEVLVGSSAGGATAGEQDYEVLLVTSSFMSPSESRSGSNPNRVRIFGPDKLVRAAAEKRWDRVKIVCSQPYSKDSPYGLSFVKFHSPPDKDEAEAPSQKVTVTKLGQFRVKEEDDSANSLRPGALFFNRINKAASASASDPAGPSYAAATLQASSAASSALPVPKVGGSSSKLQEPPKGKRKLDLGLEDSKPPSKPSAGPAALKRPKLPVPSRTPAATPASTPAQKAVPGKPRGEGTEPRGARAGPQELGKILQGVVVVLSGFQNPFRSELRDKALELGAKYRPDWTPDSTHLICAFANTPKYSQVLGLGGRIVRKEWVLDCYRMRRRLPSRRYLMAGLGSSSEDEGDSHSESGEDEAPKLPRKRPQPKAKTQAAGPSSPPRPPTPEETKAPSPGPQDNSDTDGEQSEGRDNGAEDSGDTEDELRRVAKQREQRQPPAPEENGEDPYAGSTDENTDSEAPSEADLPIPELPDFFQGKHFFLYGEFPGDERRKLIRYVTAFNGELEDYMSDRVQFVITAQEWDPNFEEALMENPSLAFVRPRWIYSCNEKQKLLPHQLYGVVPQASGGSPKKKRKV

SEQ ID NO: 71 - protein, 2257 aa, Artificial Sequence
  AXC, rXRCC1
  MISC_FEATURE (1)..(229): APOBEC
  MISC_FEATURE (234)..(863): rXRCC1
  MISC_FEATURE (880)..(2246): nCas9
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGGSPEISLRHVVSCSSQDSTHRAENLLKADTYRKWRSAKAGEKTISVVLQLEKEEQIHSVDIGNDGSAFVEVLVGSSAGGATAGEQDYEVLLVTSSFMSPSESRSGSNPNRVRIFGPDKLVRAAAEKRWDRVKIVCSQPYSKDSPYGLSFVKFHSPPDKDEAEAPSQKVTVTKLGQFRVKEEDDSANSLRPGALFFNRINKAASASASDPAGPSYAAATLQASSAASSALPVPKVGGSSSKLQEPPKGKRKLDLGLEDSKPPSKPSAGPAALKRPKLPVPSRTPAATPASTPAQKAVPGKPRGEGTEPRGARAGPQELGKILQGVVVVLSGFQNPFRSELRDKALELGAKYRPDWTPDSTHLICAFANTPKYSQVLGLGGRIVRKEWVLDCYRMRRRLPSRRYLMAGLGSSSEDEGDSHSESGEDEAPKLPRKRPQPKAKTQAAGPSSPPRPPTPEETKAPSPGPQDNSDTDGEQSEGRDNGAEDSGDTEDELRRVAKQREQRQPPAPEENGEDPYAGSTDENTDSEAPSEADLPIPELPDFFQGKHFFLYGEFPGDERRKLIRYVTAFNGELEDYMSDRVQFVITAQEWDPNFEEALMENPSLAFVRPRWIYSCNEKQKLLPHQLYGVVPQASGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 72 - protein, 2257 aa, Artificial Sequence
  XAC, rXRCC1
  MISC_FEATURE (1)..(631): rXRCC1
  MISC_FEATURE (636)..(863): APOBEC
  MISC_FEATURE (880)..(2246): nCas9
MPEISLRHVVSCSSQDSTHRAENLLKADTYRKWRSAKAGEKTISVVLQLEKEEQIHSVDIGNDGSAFVEVLVGSSAGGATAGEQDYEVLLVTSSFMSPSESRSGSNPNRVRIFGPDKLVRAAAEKRWDRVKIVCSQPYSKDSPYGLSFVKFHSPPDKDEAEAPSQKVTVTKLGQFRVKEEDDSANSLRPGALFFNRINKAASASASDPAGPSYAAATLQASSAASSALPVPKVGGSSSKLQEPPKGKRKLDLGLEDSKPPSKPSAGPAALKRPKLPVPSRTPAATPASTPAQKAVPGKPRGEGTEPRGARAGPQELGKILQGVVVVLSGFQNPFRSELRDKALELGAKYRPDWTPDSTHLICAFANTPKYSQVLGLGGRIVRKEWVLDCYRMRRRLPSRRYLMAGLGSSSEDEGDSHSESGEDEAPKLPRKRPQPKAKTQAAGPSSPPRPPTPEETKAPSPGPQDNSDTDGEQSEGRDNGAEDSGDTEDELRRVAKQREQRQPPAPEENGEDPYAGSTDENTDSEAPSEADLPIPELPDFFQGKHFFLYGEFPGDERRKLIRYVTAFNGELEDYMSDRVQFVITAQEWDPNFEEALMENPSLAFVRPRWIYSCNEKQKLLPHQLYGVVPQASGGSSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 73 - DNA, 23 bp, Artificial Sequence
  EMX1 target protospacer sequence
  misc_feature (5)..(6): Targeted C's
  misc_feature (21)..(23): PAMs
gagtccgagcagaagaagaaggg

SEQ ID NO: 74 - DNA, 23 bp, Artificial Sequence
  FANCF target protospacer sequence
  misc_feature (6)..(6): Targeted C
  misc_feature (21)..(23): PAMs
ggaatcccttctgcagcacctgg

SEQ ID NO: 75 - DNA, 23 bp, Artificial Sequence
  HEK2-1 target protospacer sequence
  misc_feature (6)..(6): Targeted C
  misc_feature (21)..(23): PAMs
gaacacaaagcatagactgcggg

SEQ ID NO: 76 - DNA, 23 bp, Artificial Sequence
  HEK2-2 target protospacer sequence
  misc_feature (6)..(6): Targeted C
  misc_feature (21)..(23): PAMs
gagcaccacaccctaaactatgg

SEQ ID NO: 77 - DNA, 23 bp, Artificial Sequence
  HEK2-3 target protospacer sequence
  misc_feature (6)..(6): Targeted C
  misc_feature (21)..(23): PAMs
ggaaacggatagttctgaaaggg

SEQ ID NO: 78 - DNA, 23 bp, Artificial Sequence
  HEK2-4 target protospacer sequence
  misc_feature (6)..(6): Targeted C
  misc_feature (21)..(23): PAMs
cttaactatttgtattccactgg

SEQ ID NO: 79 - DNA, 23 bp, Artificial Sequence
  HEK2-5 target protospacer sequence
  misc_feature (6)..(6): Targeted C
  misc_feature (21)..(23): PAMs
cttcccaagtgagaagccagtgg

SEQ ID NO: 80 - DNA, 23 bp, Artificial Sequence
  HEK2-6 target protospacer sequence
  misc_feature (6)..(6): Targeted C
  misc_feature (21)..(23): PAMs
ccagcccgctggccctgtaaagg

SEQ ID NO: 81 - DNA, 23 bp, Artificial Sequence
  HEK2-7 target protospacer sequence
  misc_feature (6)..(6): Targeted C
  misc_feature (21)..(23): PAMs
cattccgttattttacatattgg

SEQ ID NO: 82 - DNA, 23 bp, Artificial Sequence
  HEK2-8 target protospacer sequence
  misc_feature (6)..(6): Targeted C
  misc_feature (21)..(23): PAMs
gtttcctttacagggccagcggg

SEQ ID NO: 83 - DNA, 23 bp, Artificial Sequence
  HEK2-9 target protospacer sequence
  misc_feature (6)..(6): Targeted C
  misc_feature (21)..(23): PAMs
atacgcacagtttgacagatggg

SEQ ID NO: 84 - DNA, 23 bp, Artificial Sequence
  HEK2-10 target protospacer sequence
  misc_feature (6)..(6): Targeted C
  misc_feature (21)..(23): PAMs
gctggccctgtaaaggaaactgg

SEQ ID NO: 85 - DNA, 23 bp, Artificial Sequence
  HEK2-11 target protospacer sequence
  misc_feature (6)..(6): Targeted C
  misc_feature (21)..(23): PAMs
gcatgcgtgtgtgtttaagctgg

SEQ ID NO: 86 - DNA, 23 bp, Artificial Sequence
  HEK2-12 target protospacer sequence
  misc_feature (6)..(6): Targeted C
  misc_feature (21)..(23): PAMs
ttgggctgcagtaacttgaaggg

SEQ ID NO: 87 - DNA, 23 bp, Artificial Sequence
  HEK2-13 target protospacer sequence
  misc_feature (6)..(6): Targeted C
  misc_feature (21)..(23): PAMs
tctttcaagcaggtgattacagg

SEQ ID NO: 88 - DNA, 23 bp, Artificial Sequence
  HEK2-14 target protospacer sequence
  misc_feature (6)..(6): Targeted C
  misc_feature (21)..(23): PAMs
agtttcctttacagggccagcgg

SEQ ID NO: 89 - DNA, 23 bp, Artificial Sequence
  HEK2-15 target protospacer sequence
  misc_feature (6)..(6): Targeted C
  misc_feature (21)..(23): PAMs
gaggtcgtggctgagcacaaggg

SEQ ID NO: 90 - DNA, 23 bp, Artificial Sequence
  HEK2-16 target protospacer sequence
  misc_feature (6)..(6): Targeted C
  misc_feature (21)..(23): PAMs
ggcctctattgttggtagaatgg

SEQ ID NO: 91 - DNA, 23 bp, Artificial Sequence
  HEK3 target protospacer sequence
  misc_feature (4)..(5): Targeted C's
  misc_feature (21)..(23): PAMs
ggcccagactgagcacgtgatgg

SEQ ID NO: 92 - DNA, 23 bp, Artificial Sequence
  HEK4 target protospacer sequence
  misc_feature (6)..(6): Targeted C
  misc_feature (21)..(23): PAMs
ggcactgcggctggaggtggggg

SEQ ID NO: 93 - DNA, 23 bp, Artificial Sequence
  RNF2-1 target protospacer sequence
  misc_feature (6)..(6): Targeted C
  misc_feature (21)..(23): PAMs
gtcatcttagtcattacctgagg

SEQ ID NO: 94 - DNA, 23 bp, Artificial Sequence
  RNF2-2 target protospacer sequence
  misc_feature (1)..(1): Targeted C
  misc_feature (3)..(3): Targeted C
  misc_feature (5)..(5): Targeted C
  misc_feature (7)..(7): Targeted C
  misc_feature (9)..(9): Targeted C
  misc_feature (21)..(23): PAMs
cacacacacttagaatctgtggg

SEQ ID NO: 95 - DNA, 23 bp, Artificial Sequence
  RNF2-3 target protospacer sequence
  misc_feature (2)..(2): Targeted C
  misc_feature (4)..(4): Targeted C
  misc_feature (6)..(6): Targeted C
  misc_feature (8)..(8): Targeted C
  misc_feature (10)..(10): Targeted C
  misc_feature (21)..(23): PAMs
acacacacacttagaatctgtgg

SEQ ID NO: 96 - DNA, 23 bp, Artificial Sequence
  GJB2 target protospacer sequence
  misc_feature (6)..(6): Targeted C
  misc_feature (21)..(23): PAMs
ggacacgaagatcagctgcaggg

SEQ ID NO: 97 - DNA, 23 bp, Artificial Sequence
  ADRB2 target protospacer sequence
  misc_feature (7)..(7): Targeted C
  misc_feature (21)..(23): PAMs
ccctttcctgcgtgacgtcgtgg

SEQ ID NO: 98 - DNA, 23 bp, Artificial Sequence
  MYBPC3 target protospacer sequence
  misc_feature (7)..(7): Targeted C
  misc_feature (21)..(23): PAMs
ccctttcctgcgtgacgtcgtgg

SEQ ID NO: 99 - DNA, 23 bp, Artificial Sequence
  GAL 292 target protospacer sequence
  misc_feature (6)..(6): Targeted C
  misc_feature (21)..(23): PAMs
gaagtcgttgtcaaacaggaagg

SEQ ID NO: 100 - DNA, 23 bp, Artificial Sequence
  VEGFA-1 target protospacer sequence
  misc_feature (6)..(6): Targeted C
  misc_feature (21)..(23): PAMs
gatgtctgcaggccagatgaggg

SEQ ID NO: 101 - protein, 16 aa, Artificial Sequence
  Linker
SGSETPGTSESATPES

SEQ ID NO: 102 - protein, 4 aa, Artificial Sequence
  Linker
SGGS

SEQ ID NO: 103 - protein, 8 aa, Artificial Sequence
  Linker
SGGSGGGS

SEQ ID NO: 104 - protein, 5 aa, Artificial Sequence
  Linker
GGGGS

SEQ ID NO: 105 - protein, 5 aa, Artificial Sequence
  Linker
EAAAK

The invention claimed is:

1. A fusion protein or a protein complex comprising
(i) a DNA binding protein (DnaBP), wherein the DnaBP is a Cas9 nickase;
(ii) a nucleobase modifying protein (NMP), wherein the NMP is a cytosine deaminase domain from an apolipoprotein B mRNA-editing complex (APOBEC) family deaminase; and
(iii) a Base Excision Repair associated protein (BERAP), wherein the BERAP is XRCC,
wherein the fusion protein or protein complex does not comprise a Uracil binding protein or a catalytically active DNA polymerase.

2. The fusion protein according to claim 1, wherein an orientation of the DnaBP, NMP, and BERAP within the fusion protein is selected from the group consisting of: [NMP]-[DnaBP]-[BERAP], [NMP]-[BERAP]-[DnaBP] and [BERAP]-[NMP]-[DnaBP]; wherein each instance of "]-[" comprises an optional linker.

3. The fusion protein according to claim 2, wherein an orientation of the DnaBP, NMP, and BERAP within the fusion protein is [NMP]-[DnaBP]-[BERAP].

4. A fusion protein comprising:
(i) a first amino acid sequence that is at least 90% identical to the amino acid sequence of SEQ ID NO: 1;
(ii) a second amino acid sequence that is at least 90% identical to the amino acid sequence of SEQ ID NO: 3; and
(iii) a third amino acid sequence that is at least 90% identical to the amino acid sequence of SEQ ID NO: 4 or 5.

5. A protein complex comprising:
(i) a first protein comprising an amino acid sequence that is at least 90% identical to the amino acid sequence of SEQ ID NO: 1;
(ii) a second protein comprising an amino acid sequence that is at least 90% to the amino acid sequence of SEQ ID NO: 3; and
(iii) a third protein comprising an amino acid sequence that is at least 80% 90% identical to the amino acid sequence of SEQ ID NO: 4 or 5.

6. A polynucleotide encoding the fusion protein or protein complex of claim 1.

* * * * *